United States Patent
Blumenfeld et al.

(10) Patent No.: US 6,528,260 B1
(45) Date of Patent: Mar. 4, 2003

(54) BIALLELIC MARKERS RELATED TO GENES INVOLVED IN DRUG METABOLISM

(75) Inventors: Marta Blumenfeld, Paris (FR); Ilya Chumakov, Vaux-le-Penil (FR); Lydie Bougueleret, Vanves (FR); Annick Cohen, Paris (FR)

(73) Assignee: Genset, S.A. (FR)

( * ) Notice: Subject to any disclaimer, the term of this patent is extended or adjusted under 35 U.S.C. 154(b) by 20 days.

(21) Appl. No.: 09/671,317

(22) Filed: Sep. 27, 2000

Related U.S. Application Data

(63) Continuation-in-part of application No. 09/536,178, filed on Mar. 23, 2000.
(60) Provisional application No. 60/126,269, filed on Mar. 25, 1999, and provisional application No. 60/131,961, filed on Apr. 30, 1999.
(51) Int. Cl.$^7$ .............................. C12Q 1/68; C12Q 1/00; C07H 21/04; G01N 33/48; G01N 33/50
(52) U.S. Cl. ................................ 435/6; 435/4; 702/19; 702/20; 536/23.1
(58) Field of Search ................................ 435/6; 702/19

(56) References Cited

U.S. PATENT DOCUMENTS 5,919,627 A * 7/1999 Lal et al. ........................ 435/6

FOREIGN PATENT DOCUMENTS

| EP | 0 723 021 A | 7/1996 |
| WO | WO 98 30883 A | 7/1995 |

OTHER PUBLICATIONS

HSU77604, GENBANK, Sep. 29, 1997.*
Forsberg et al., "Oxidative Stress, Human Genetic Variation, and Disease", Archives of Biochemisty and Biophysics vol. 389 No. 1 May 1, 2001 pp. 84–93.*
Scoggan et al., "production of Leukoriene C4 in Different Human Tissues Is Attributable to Distinct Membrane Bound Biosynthetic Enzmes", J. of Biological Chemistry (1997) vol. 272 No. 15 pp. 10182–10187.*

H. Raunio, et al.: "Diagnosis of polymorphisms in carcinogen–activating and inactivating enzymes and cancer susceptiblility—a reviw"; Gene, Elsevier Biomedical Press, Amsterdam, NL. vol. 159, No. 1; Jun. 14, 1995, pp. 113–121, XP004042243; ISSN: 0378–1119.

M. Sanak, et al.; "leukotriene C4 synthase promotor polymophism and risk of aspirin–induced asthma"; The Lancet, Lancet Limited; London, GB; vol. 350, Nov. 29, 1997; pp. 1599–1600; XP002086063; ISSN 0140–6736.

Anderson M.E., "Glutathione and Glutathione Delivery Compounds", Advances in Pharmacology, 38: 65–74, 1997.

Jakobsson, P.J., et al., "Identification and Characterization of a Novel Human Microsomal Glutathione S–Transferase with Leukotriene C4 Synthese Activity and Significant Identity to 5–Lipoxygenase–Activating Protein and Leukotriene C4 Synthase", Journal of Biological Chemistry, 271:22203–22210, 1996.

Petric, R., et al., "Renal Leukotriene C4 Synthase: Characterization, Partial Purification and Alterations in Experimental Glomerulonephritis", Biochim. Biophys. Acta, 1254:207–215, 1995.

Stenke, L., et al., "Increased Leukotriene C4 Production in Chronic Myelogenous Leukemia", Acta Oncologica, 27:803–805, 1987.

* cited by examiner

*Primary Examiner*—Michael P. Woodward
*Assistant Examiner*—Lou A Clow
(74) *Attorney, Agent, or Firm*—Saliwanchik, Lloyd & Saliwanchik

(57) ABSTRACT

The invention provides polynucleotides including biallelic markers derived from genes involved in the biotransformation of xenobiotics such as drugs and from genomic regions flanking those genes. Primers hybridizing to regions flanking these biallelic markers are also provided. This invention also provides polynucleotides and methods suitable for genotyping a nucleic acid containing sample for one or more biallelic markers of the invention. Further, the invention provides methods to detect a statistical correlation between a biallelic marker allele and a phenotype and/or between a biallelic marker haplotype and a phenotype.

4 Claims, No Drawings

BIALLELIC MARKERS RELATED TO GENES INVOLVED IN DRUG METABOLISM

RELATED APPLICATIONS

This application is a continuation-in-part of U.S. patent application Ser. No. 09/536,178 filed Mar. 23, 2000 and International Patent Application No. PCT/IB00/00403, filed Mar. 24, 2000 both of which claim priority to U.S. Provisional Patent Application Serial No. 60/126,269 filed Mar. 25, 1999 and U.S. Provisional Patent Application Serial No. 60/131,961 filed Apr. 30, 1999. All of the above applications are hereby incorporated herein in their entirety including any figures, tables, or drawings.

FIELD OF THE INVENTION

The present invention is in the field of pharmacogenomics, and is primarily directed to biallelic markers that are located in or in the vicinity of genes, which have an impact on the metabolism of xenobiotics such as drugs and the uses of these markers. The present invention encompasses methods of establishing associations between these markers and a phenotype such as drug response, toxicity and susceptibility to disease. The present invention also provides means to determine the genetic predisposition of individuals to such drug responses, toxicity and diseases.

BACKGROUND OF THE INVENTION

To assess the origins of individual variations in drug response, pharmacogenomics uses the genomics technologies to identify polymorphisms within genes associated with drug response. In this respect, there are three main categories of genes that may theoretically be expected to be associated with drug response, namely genes linked with the targeted disease, genes related to the drug's mode of action and genes involved in the drug's metabolism. Among these genes of pharmacogenomic importance, genes coding for drug-metabolizing enzymes have a central role.

Drug Metabolism

Drug-metabolizing enzymes are important determinants of drug disposition, safety and efficacy. The enzyme systems involved in the metabolism and the subsequent elimination from the body of environmental chemicals, food toxins and drugs are mainly localized in the liver, although every tissue examined has some metabolic activity.

In order to produce its characteristic effects, a given drug must be present in appropriate concentrations at its sites of action. The absorption, distribution, biotransformation and excretion of a drug all involve its passage across cell membranes. The lipophilic characteristics of drugs that promote their passage through biological membranes and subsequent access to their site of action reduce their elimination from the body. Renal excretion of unchanged drug plays only a modest role in the overall elimination of most therapeutic agents, since lipophilic compounds filtered through the glomerulus are largely reabsorbed through the tubular membranes. Biotransformation of drugs into more hydrophilic metabolites plays a major role in the termination of their biological activity and their elimination from the body. In general, biotransformation reactions generate more polar, inactive metabolites that are readily excreted from the body. However in some cases, metabolites with potent biological activity or toxic properties are generated and may result in adverse side effects. Metabolic biotransformation of drugs can be classified as either Phase I fumctionalization reactions or Phase II biosynthetic reactions. Phase I reactions introduce or expose a functional group on the parent compound, and generally result in the loss of pharmacological activity although there are some examples of retention or enhancement of activity. Phase II conjugation reactions lead to the formation of a covalent linkage between a functional group on the parent compound with glucuronic acid, sulfate, glutathione, amino acids or acetate. These highly polar conjugates are generally inactive and are excreted rapidly in the urine and feces. Within a given cell, most drug metabolizing Phase I enzymes are located primarily in the endoplasmic reticulum, while the Phase II conjugation enzyme systems are mainly cytosolic. In some cases, drugs biotransformed through a Phase I reaction in the endoplasmic reticulum are further metabolized by conjugation in the cytosolic fraction of the same cell (Hardman J. G., Goodman, Gilman A., Limbird L. E.; *Goodman & Gilman's The Pharmacological Basis of Therapeutics*, $9^{th}$ edition, McGraw-Hill, N.Y., 1996).

Enzymes Involved in the Biotransformation of Xenobiotics

Besides being involved in the biotransformation of drugs, drug-metabolizing enzymes are also involved in the metabolism of xenobiotics (foreign compounds) as well as in the metabolism of endogenous compounds including steroids, vitamins and fatty acids. Foreign compounds include therapeutic agents, carcinogens, plant metabolites, environmental pollutants, foodstuffs and other dietary components as well as industrial chemicals. The biotransformation of foreign compounds (xenobiotics) is often regarded as detoxification because it usually converts compounds into more water-soluble, readily excreted substances. This tends to decrease the exposure of the organism to the compound and therefore tends to decrease toxicity. However, in some cases the reverse occurs and a metabolite is produced which is more toxic than the parent compound. For example, drug-metabolizing enzymes may activate some carcinogens, and interindividual differences in cancer susceptibilities, have been linked to polymorphisms in drug-metabolizing enzymes. There are many factors, which affect biotransformation and toxicity, such as the dose, availability of cofactors and the relative activity of the various drug-metabolizing enzymes. There may also be several competing pathways of metabolism—some leading to detoxification others to toxicity. Factors, such as genetic factors or environmental factors, which influence the balance between these competing pathways, will also determine the eventual toxicity.

As mentioned above, the metabolic conversion of drugs and other xenobiotics is enzymatic in nature. The enzyme systems involved in the biotransformation of drugs are localized in the liver, although every tissue examined has some metabolic activity. Other organs with significant metabolic capacity include the kidneys, gastrointestinal tract, skin and lungs. Following non-parenteral administration of a drug, a significant portion of the dose may be metabolically inactivated in either the liver or intestines before it reaches the systemic circulation. This first-pass metabolism significantly limits the oral availability of highly metabolized drugs.

Cytochrome P450

The cytocbrome P450 enzyme family is the major catalyst of biotransformation reactions. Since its origin, the cytochrome P450 gene family has diversified to accommodate the metabolism of a growing number of environmental chemicals, food toxins and drugs. The resulting superfamily of enzymes catalyzes a wide variety of oxidative and reductive reactions and has activity towards a chemically diverse group of substrates. Cytochrome P450 enzymes are heme-containing membrane proteins localized in the smooth endoplasmic reticulum of numerous tissues. Oxidative reactions catalyzed by the microsomal monooxygenase system require the cytochrome P450 hemoprotein, NADPH-cytochrome P450 reductase, NADPH, and molecular oxygen. Oxidative biotransformations catalyzed by cytochrome P450 monooxygenases include aromatic and side chain hydroxylation, N-, O-, S- dealkylation, N-oxidation, sulfoxidation, N-hydroxylation, deamination, dehalogenation, and desulfuration. Cytochrome P450 enzymes also catalyze a number of reductive reactions, generally under conditions of low oxygen tension. The only common structural feature of the diverse group of xenobiotics oxidized by cytochrome P450 enzymes is their high lipid solubility.

Twelve cytochrome P450 gene families have been identified in human beings, and a number of distinct cytochrome P450 enzymes often exist within a single cell. The cytochrome P450 1, 2 and 3 families (CYP1, CYP2, CYP3) encode the enzymes involved in the majority of all drug biotransformations, while the gene products of the remaining cytochrome P450 families are important in the metabolism of endogenous compounds such as steroids and fatty acids. CYP1A2 gene expression may play an important role in individual risk of environmental toxicity or cancer. CYP1A2 substrates include clinically important drugs such as imipramine, propranolol, paracetamol, clozapine, theophyline, caffeine and acetaminophen. CYP1A2 is also involved in the conversion of heterocyclic amines and arylamines to their proximal carcinogenic and mutagenic forms, as well as in the metabolism of endogenous substances including estradiol and uroporphyrinogen III. Interindividual differences in susceptibility to arylamine- and heterocyclicamine-induced cancers have been linked to CYP1A2 polymorphism. CYP2C8 appears to be responsible for retinol and retinoic acid metabolism and actively catalyzes benzphetamine N-demethylation. CYP2C9 catalyzes the hydroxylation of tolbutamide, a hypoglycemic agent used in the treatment of type II diabetes mellitus, and one allelic variant of CYP2C9 accounts for the occurrence of poor metabolizers of tolbutamide. CYP2C9 may also have an important role in terminating the anti-coagulant activity of warfarin. Widespread interindividual differences in the response to warfarin have been recognized. Such variability is particularly important for drugs such as warfarin which have narrow therapeutic indices (Steward D. J. et al., *Pharmacogenetics*, 7:361-367, 1997). CYP2C9 is further involved in the oxidation of tielinic acid and several nonsteroidal anti-inflammatory agents. The oxidative metabolism through CYP2C9 of tilenic acid can result in the emergence of a drug induced autoimmune hepatitis. CYP3A4 is involved in the biotransformation of a majority of drugs and is expressed at significant levels extrahepatically. It is now recognized that extensive metabolism by CYP3A4 in the gastrointestinal tract is a significant factor contributing to the poor oral availability of many drugs (first-pass metabolism). Barbiturates, certain steroids and macrolide antibiotics can induce this enzyme. It appears to play a central role in the metabolism of the immunosuppressive cyclic peptide cyclosporin A as well as macrolide antibiotics, such as erythromycin.

Flavin-Containing Monooxygenases (FMOs)

The mammalian flavin-containing monooxygenases (FMOs) are microsomal enzymes that catalyze the NADPH-dependent oxygenation of a wide variety of drugs and other xenobiotics that possess a soft nucleophilic heteroatom, typically a nitrogen, sulfur, phosphorus or selenium atom. Of special clinical interest is the oxidation of trimethylamine in the liver by the FMO, because its deficiency causes the "Fish Odor Syndrome." Drugs oxidized by FMOs include, among others, antidepressant, antipsychotic-neuroleptic, antihypertensive drugs. FMOs have been implicated in the detoxification but also in the metabolic activation of several different environmental toxins and carcinogens.

Unlike all other known oxidases and monooxygenases, among which the well-studied cytocbrome P450 monooxygenases, FMOs have the unique property of forming a stable enzyme intermediate in the absence of an oxygenatable substrate. Because the energy for catalysis is already present in the FMO enzyme before contact with the potential substrate, the fit of the substrate does not need to be as stringent as with the other enzymes. This feature, unique to FMOs among monooxygenases, is responsible for the wide range of substrates accepted by FMOs (including tertiary and secondary alkyl- and arylamines, many hydrazines, thiocarbamides, thioamides, sulfides, disulfides, thiols, among others), and determines that any soft nucleophilic xenobiotic accessible to the active enzyme will probably be oxidized by FMO in vivo. Although some FMO substrates are oxidized to less active derivatives, several soft nucleophiles are metabolized to highly reactive and potentially toxic intermediates.

The FMOs represent a multigene family. Five distinct mammalian FMO isoenzymes have been identified and cloned from various animal and human tissues: FMO1, FMO2, FMO3, FMO4 and FMO5. Human FMO2 and human FMOX were cloned and sequenced by the inventors as described in PCT Publication WO 9824914. FMOX represents a new member of the FMO gene family not previously identified in mammals. Tissue specificity and activities of the different FMOs have been thoroughly characterized. FMO1 is known to be expressed in the human kidney but is absent from the liver. In man the enzyme is subject to developmental regulation. FMO2 is predominantly expressed in lung of all mammalian species tested. FMO3 was isolated from human liver, and accounts for the majority of FMO expressed in adult human liver.

Many of the FMO substrates may also be oxidized by the cytochrome P450 monooxygenases. However, the final oxidation products are usually different, and the nitrogen of a specific compound is rarely N-oxygenated by both types of monooxygenases. Today, a large number of drugs in human clinical trials contain a nitrogen, sulfur, phosphorous or some other nucleophilic functionality. Of the two major monooxygenase systems considered to be responsible for heteroatom-containing chemical and drug oxidative metabolism (CYP 450 and FMO), relatively little is known concerning the role of the FMO in human drug metabolism. Yet, given the wide range of substrates potentially oxidized by FMOs, this class of monooxygenases seems to represent a major determinant of drug safety and efficacy.

Uridine Diphosphate Glucoronosyl Transferase (UGTs)

Glucoronidation is a major detoxification pathway of Phase II metabolism that is catalyzed by the UDP-glucuronosyl transferase family of enzymes. Glucuronidation is quantitatively the most important conjugation reaction. Members of this enzyme family catalyze the conjugation of numerous endogenous substances of widely differing structures such as bilirubin, steroid hormones and fat-soluble vitamins. In general, xenobiotics become substrates for glucoronidation by first passing through Phase I metabolism, but many compounds do not require this step because they already possess reactive functionalities (e.g. hydroxyl, carboxyl, amino, sulfhydryl etc.) that are direct targets for glucuronosyl transferase. The human UGT genes appear to have evolved by a series of gene-duplication and gene-conversion events resulting in the emergence of a diversity of isoforms. They are divided into two families, UGT1 which is known to have bilirubin and phenol as substrates, and UGT2 which is known to have steroid, bile, and odorant as substrates, with these two families located on different chromosomes. The UGT2 family is divided into subfamilies UGT2A and UGT2B. The UGTs have different but sometimes overlapping substrate specificities. They catalyze the transfer of an activated glucuronic acid molecule to aromatic and aliphatic alcohols, carboxylic acids, amines and free sulfhydryl groups of both exogenous and endogenous compounds, to form O- N- and S-glucuronide conjugates. The increased water solubility of the glucuronide conjugates promotes their elimination in the urine or bile. In addition to high levels of expression in the liver, UGTs are also found in the kidney, intestine, brain and skin. Glucoronidation constitutes, from a general point of view, a reaction of detoxification and elimination. It generally leads to the formation of inactive metabolites and therefore, glucoronidation can dramatically modify the pharmacological activity of a drug. Moreover, UGTs play a major role in the elimination of nucleophilic metabolites of carcinogens, such as phenols and quinols of polycyclic aromatic hydrocarbons. In this way they prevent their further oxidation to electrophiles, which may react with DNA, RNA or protein. On the other hand, glucoronidation of certain compounds facilitates metabolic activation. Aromatic amines are some of the most studied examples of the role glucoronidation plays in metabolic activation of carcinogens. Glucoronidation has also been implicated in adverse drug reactions of certain carboxylic drugs, which resulted in a toxic immunological response. Glucoronidation although generally a detoxification reaction, may occasionally be involved in increasing toxicity.

Glutathione Conjugation and Further Metabolism

Glutathione is a tripepetide (γ-glutamylcysteinylglycine, GSH) found in high concentrations in most mammalian tissues, but especially in the liver. Glutathione has several functions including roles in metabolism, transport and catalysis. Glutathione is also important for the maintenance of the thiol moieties of proteins and for the maintenance of the reduced form of other molecules such as cysteine, coenzyme A, and antioxidants such as ascorbic acid; it is also used in the formation of deoxyribonucleic acids (Anderson M. E., *Advances in Pharmacology*, 38: 65–74, 1997). Glutathione has a major protective role in the body, as it is the major cellular antioxidant. GSH can react non-enzymatically with reactive oxygen species (ROS) and thereby protect the cell from oxidative damage. ROS have been widely implicated in the pathology of numerous diseases such as arteriosclerosis, rheumatoid arthritis, cancer, AIDS, adult respiratory distress syndrome and Parkinson's disease.

Moreover, conjugation with the tripeptide glutathione represents a major detoxification pathway for xenobiotics including drugs and carcinogens. Glutathione may react either chemically or in enzyme catalyzed reactions with a variety of compounds, which are reactive electrophilic metabolites produced in Phase I reactions. The glutathione S-transferase enzymes (GSTs) that catalyze these reactions are members of a multigene family and are expressed in virtually all tissues. Glutathione conjugates are cleaved to cysteine derivatives and subsequently are acetylated by a series of enzymes located primarily in the kidney to give N-acetylcysteine conjugates collectively referred to as mercapturic acids. Mercapturic acid derivatives are the ultimate metabolites excreted in the urine. This is a particularly important route of Phase II metabolism from the toxicological point of view, as it is often involved in the removal of reactive intermediates. Xenobiotics that act as substrates for the glutathione S-transferases (GSTs) fall into four broad categories: electropilic carbon, nitrogen, sulfur and oxygen. Examples of substrates for glutathione S-transferases include aromatic, heterocyclic, alicyclic and aliphatic epoxides; aromatic halogen and nitro compounds; alkyl halides; and unsaturated aliphatic compounds (Ballantyne, B., Marrs T. and Turner P., *General & Applied Toxicology*, Stockton Press, New York, 1993). The GSTs are also involved in the metabolism of endogenous molecules such as the leukotrienes. As mentioned above, many of the enzymes involved in xenobiotic metabolism are also involved in specific aspects of the metabolism of normal cellular biochemical constituents. Leukotrienes are important mediators and modulators of the inflammatory reaction and contribute to a number of physiological and pathological processes. Moreover, the GSTs are also capable of directly binding hydrophobic compounds such as heme, bilirubin, and steroids, which may enable them to serve as intracellular storage and transport proteins for biological substances with limited water solubility. By their catalytic activity and their capacity for binding, the GSTs provide the cell with mechanism to protect itself from the noxious effects of various xenobiotics and endogenous substances. Further, GSTs may undergo amplification in tumors and may thereby be implicated in drug resistance in cancer chemotherapy. GSTs are mostly cytosolic although, more recently, microsomal GSTs have been identified. Human microsomal GST II (MGST II) is a member of the microsomal glutathione S-transferase family. This enzyme catalyzes the production of LTC4 (leukotriene C4) from LTA4 (leukotriene A4) and reduced glutathione. Leukotrienes are derived from arachidonic acid and related fatty acids. Metabolites of arachidonic acid have been collectively termed eicosanoids, the principal eicosanoids are prostaglandins, thromboxanes and leukotrienes (LT). Eicosanoids are among the most important chemical mediators and modulators of the inflammatory reaction and contribute to a number of physiological and pathological processes (see Hardman J. G., Goodman, Gilman A., Limbird L. E.; *Goodman & Gilman's The Pharmacological Basis of Therapeutics*, $9^{th}$ edition, McGraw-Hill, N.Y., 1996). The ability to mount an inflammatory response is essential for survival in the face of environmental pathogens and injury, although in some situations and diseases the inflammatory response may be exaggerated and sustained for no apparent beneficial reason. This is the case in numerous chronic inflammatory diseases and allergic inflammation. Acute allergic inflammation is characterized by increased blood flow, extravasation of plasma and recruitment of leukocytes. These events are triggered by locally released inflammatory mediators including eicosanoids and more particularly leukotrienes. The participation of arachidonic acid metabolism in inflammatory diseases such as rheumatoid arthritis, asthma and acute allergy is well established. Pathological actions of leukotrienes are best understood in terms of their roles in immediate hypersensitivity and asthma. LTC4 and LTD4 are potent bronchoconstrictors, they act principally on smooth muscle in peripheral airways and are a 1000 times more potent than histamine both in vitro and in vivo. They also stimulate bronchial mucus secretion and cause mucosal edema. A complex mixture of chemical messengers is released when sensitized lung tissue is challenged by the appropriate antigen. Various prostaglandins and leukotrienes are prominent components of this mixture. Response to the leukotrienes probably dominates during allergic constriction of the airway. A particularly important role for the cysteinyl-leukotrienes (LTC4, LTD4, and LTE4) has been suggested in pathogenesis of asthma, which is now recognized as a chronic inflammatory condition. They are potent spasmogens causing a contraction of bronchiolar muscle and an increase in mucus secretion. An increased LTC4 formation has also been reported in leukocytes from patients with chronic myelogenous leukemia (Stenke et al., *Acta Oncologica*, 27:803–805, 1987) and in experimental glomerulonephritis (Petric et al., *Biochim. Biophys. Acta*, 1254:207–215, 1995).

Moreover, MGST II has the capacity to conjugate other compounds such as 1-chloro-2,4 dinitrobenzene with glutathione and may be involved in a general metabolic system for detoxifying fatty acid epoxides (Jakobsson et al., *Journal of Biological Chemistry*, 271:22203–22210, 1996).

The resulting glutathione conjugate usually undergoes further metabolism, which involves first a removal of the glutamyl residue, catalyzed by γ-glutamyltransferase (GGT). In addition to catalyzing the initial step in the conversion of glutathione-conjugated compounds to mercapturic acids, GGT also converts LTC4 to LTD4. Interestingly, expression of GGT is often increased in cancerous tissues.

Renal dipeptidase is also implicated in the renal metabolism of glutathione and its conjugates including conjugated xenobiotics and endogenous molecules such as Leukotriene D4. Pharmacologically it is an important enzyme, for it is responsible for hydrolysis of some β-lactam antibiotics such as penem and carbapenem.

The effectiveness of the GSTs and therefore of detoxification by glutathione conjugation in general as well as the ability of the cell to resist to oxidative stress, are strongly influenced by the availability of reduced glutathione. Reduction of oxidized glutathione and de novo synthesis of glutathione, are both completely dependent on NADPH. Glutathione reductase (GSHR) maintains high levels of reduced glutathione in the cytosol in an NADPH dependent reaction. Reduced glutathione is synthesized de novo in the cytosol of most cells via the γ-glutamyl cycle; a series of tightly controlled, enzyme catalyzed reactions. The first and second step in the de novo glutathione biosynthesis are catalyzed by γ-glutamylcysteine synthetase (GLCL) and glutathione synthase (GSHS) respectively. Deficiencies in γ-glutamylcysteine synthetase and GSH synthetase are associated with hemolytic anemia and impaired central nervous system function. Glucose 6-phosphate Dehydrogenase (G6PDH), Phosphogluconate Dehydrogenase (PGDH) and Malate Dehydrogenase: Generation of NADPH NADPH (nicotinamide adenine dinucleotide phosphate) serves as an electron donor in reductive biosyntheses. In the pentose phosphate pathway, NADPH is generated when glucose 6-phosphate is oxidized to ribose 5-phosphate. G6PDH and PGDH are key enzymes of the pentose phosphate pathway and directly lead to the generation of NADPH. Another major source of NADPH is the oxidative decarboxylation of malate by malic enzyme.

NADPH may be used in anabolic processes such as fatty acid biosynthesis. One of the major functions of malic enzyme may be supplying NADPH to the cytosol for the synthesis of fatty acids from acetyl CoA (coenzyme A). Further, the cytochrome P450 system is dependent on NADPH. As mentioned above, availability of NADPH is also critical for the reduction of glutathione. The connection between generation of NADPH and reduction of glutathione is clearer in tissues that have limited glycolytic metabolism, e.g. the lens and the erythrocyte. Thus the viability of the erythrocyte depends on glutathione, kept reduced by this pathway. Moreover, factors that influence the availability of reduced glutathione drastically alter the effectiveness of glutathione S-transferases therefore also affecting drug metabolism. Under most conditions saturating levels of NADPH are provided to the cell. However, certain conditions can stress the ability of the cell to provide NADPH and it may become rate limiting.

G6PDH and PGDH are present in most cells and tissues. They serve as the key enzymes of the pentose phosphate pathway that control the flow of carbon through the pathway and produce reducing equivalents as NADPH to meet cellular needs for reductive biosynthesis and to maintain the redox state of the cell at physiological levels. Deficiency of G6PDH and PGDH leads to decreased levels of NADPH and is associated with hemolytic anemia in response to oxidative stress. The red cells of G6PDH deficient persons are susceptible to hemolysis by dietary substances, and by drugs such as primaquine, sulfones, sulfonamides, nitrofurans, vitamin K analogs, acetophenetidin, chloramphenicol, and many others.

Genetic Polymorphisms in Drug Metabolizing Enzymes and Pharmacogenomics

Genetic, environmental, and physiological factors are involved in the regulation of drug biotransformation reactions. Results obtained from epidemiological studies and experimental animal model systems have shown a wide range of phenotypic variation in the ability of individuals to metabolize drugs and environmental chemicals. While some of this variation can be attributed to different environmental exposures, it has become clear that genetic factors also play an important role in determining the response of the individual to exogenous agents. Certain allelic forms of drug-metabolizing enzymes can render the individual either more sensitive or resistant to the toxic or therapeutic effects of exogenous drugs and chemicals. Genetic factors seem to be the major determinants of the variability of drug effects and are responsible for a number of striking quantitative and qualitative differences in pharmacological activity. Genetic differences in the ability of individuals to metabolize a drug through a given pathway are an important contributor to the large interindividual differences of drug efficacy and adverse effects within a population. There are many diverse examples of xenobiotics whose toxicity is directly dependent on the activity of drug-metabolizing enzymes. Often impaired metabolism of a drug through a genetically polymorphic pathway has been associated with an increased incidence of adverse effects in the slow metabolizer population (Weber W. W., *Pharmacogenetics*, Oxford University Press, N.Y., 1997). Moreover, genetic differences in the regulation, expression and activity of genes coding for Phase I and Phase II drug-metabolizing enzymes can be crucial factors in defining cancer susceptibility and the toxic or carcinogenic power of environmental chemicals and xenobiotics. In addition, the majority of serious cases of drug-drug interactions are a result of the interference of the metabolic clearance of one drug by a coadministered drug. The interference usually occurs via inhibition or induction of drug-metabolizing enzymes. Interindividual differences in susceptibility to severe drug-drug interactions also involve drug-metabolizing enzyme polymorphism. In some cases the design of the drug takes into account the activity of drug-metabolizing enzymes. For example, prodrugs require activation by drug-metabolizing enzymes to exhibit their therapeutic activity. The activation and efficiency of such prodrugs depends on interindividual polymorphism in drug-metabolizing enzymes.

Individual differences in metabolism of therapeutics can lead to severe toxicity or therapeutic failure. Therapeutic management and drug development can be markedly improved by the identification of specific genetic polymorphisms that determine and predict patient susceptibility to diseases or patient responses to drugs. Assessing individual risk rather than population risk will lead to better targeted therapeutic strategies defining individual drug usage based on a benefit/risk prognosis. To assess the origins of individual variations in disease susceptibility or drug response, pharmacogenomics uses the genomic technologies to identify polymorphisms within genes, which are part of biological pathways involved in disease susceptibility, etiology, and development, or more specifically in drug response pathways responsible for a drug's efficacy, tolerance or toxicity. It can provide tools to refine the design of drug development by decreasing the incidence of adverse events in drug tolerance studies, by better defining patient subpopulations of responders and non-responders in efficacy studies and, by combining the results obtained therefrom, to further allow better enlightened individualized drug usage based on efficacy/tolerance prognosis. Pharmacogenomics can also provide tools to identify new targets for designing drugs and to optimize the use of already existing drugs, in order to either increase their response rate and/or exclude non-responders from corresponding treatment, or decrease their undesirable side effects and/or exclude from corresponding treatment patients with marked susceptibility to undesirable side effects.

Drug-metabolizing enzymes are highly relevant to pharmacogenomics because they are at the core of drug response, drug efficacy and toxicity. Drug-metabolizing enzymes also determine an individual's susceptibility to exogenous chemicals and to a number of diseases associated with exposure to toxic or carcinogenic chemicals.

The complexity of the pathways and enzymes that are involved in detoxification and metabolism of drugs has limited the precise identification of the drug-metabolizing enzymes, which play the causal role in pathologies or in drug response. Therapeutic management and drug development can be markedly improved by the identification of genetic markers derived from drug-metabolizing enzymes that predict patient susceptibility to diseases or patient responses to drugs.

Genetic Analysis of Complex Traits

Until recently, the identification of genes linked with detectable traits has relied mainly on a statistical approach called linkage analysis. Linkage analysis is based upon establishing a correlation between the transmission of genetic markers and that of a specific trait throughout generations within a family. Linkage analysis involves the study of families with multiple affected individuals and is useful in the detection of inherited traits, which are caused by a single gene, or possibly a very small number of genes. Linkage analysis has been successfully applied to map simple genetic traits that show clear Mendelian inheritance patterns and which have a high penetrance (the probability that a person with a given genotype will exhibit a trait). About 100 pathological trait-causing genes have been discovered using linkage analysis over the last 10 years.

But, most traits of medical relevance do not follow simple Mendelian monogenic inheritance and linkage studies have proven difficult when applied to complex genetic traits. Many complex traits such as height, blood pressure or cancer susceptibility have been known to run in families and are at least partially determined by genetic factors. However, the genes or combination of genes that underlie these observable characteristics or traits remain unknown in most cases. Such complex traits are often due to the combined action of multiple genes as well as environmental factors. Because of their low penetrance, such complex traits do not segregate in a clear-cut Mendelian manner as they are passed from one generation to the next. Drug efficacy, response and tolerance/toxicity can also be considered as multifactoral traits involving a genetic component in the same way as complex diseases. Linkage analysis is impractical when the trait under study is drug response due to the lack of availability of familial cases. In fact, the likelihood of having more than one individual in a family being exposed to the same drug at the same time is very low. Linkage analysis cannot be applied to the study of such traits for which no large informative families are available. Attempts to map complex traits have been plagued by inconclusive results, demonstrating the need for more sophisticated genetic tools.

Knowledge of genetic variation in drug-metabolizing enzymes is important for understanding why some people are more susceptible to toxicity, pathology or respond differently to drugs. Ways to identify genetic polymorphism and to analyze how they impact and predict disease susceptibility and response to treatment are needed.

Whereas a number of polymorphisms and rare mutations have been identified in drug-metabolizing enzymes (see Weber W. W., *Pharmacogenetics,* Oxford University Press, New York, 1997), genetic markers for use in determining which genes contribute to multigenic or quantitative traits and suitable methods for exploiting those markers have not been found and brought to bare on the genes coding for drug-metabolizing enzymes.

SUMMARY OF THE INVENTION

The present invention is based on the discovery of a set of novel DME-related biallelic markers. See Table 11(A–B). These markers are located in the coding regions as well as non-coding regions adjacent to genes which are involved in the metabolic conversion of drugs and other xenobiotics. The position of these markers and knowledge of the surrounding sequence has been used to design polynucleotide compositions which are useful in determining the identity of nucleotides at the marker position, as well as more complex association and haplotyping studies which are useful in determining the genetic basis for variability in drug response and adverse reactions to drugs as well as the genetic basis for disease states involving the metabolic conversion of xenobiotics such as drugs. In addition, the compositions and methods of the invention find use in the identification of the targets for the development of pharmaceutical agents and diagnostic methods, as well as the characterization of the differential efficacious responses to and side effects from pharmaceutical agents.

The present invention further stems from the isolation and characterization of the genomic sequence of the MGST-II gene including its regulatory regions and of the complete cDNA sequence encoding the MGST-II enzyme. Oligonucleotide probes and primers hybridizing specifically with a genomic sequence of MGST-II are also part of the invention. A further object of the invention consists of recombinant vectors comprising any of the nucleic acid sequences described in the present invention, and in particular of recombinant vectors comprising the promoter region of MGST-II or a sequence encoding the MGST-II enzyme, as well as cell hosts comprising said nucleic acid sequences or recombinant vectors. The invention also encompasses methods of screening of molecules which, modulate or inhibit the expression of the MGST-II gene. The invention is also directed to biallelic markers that are located within the MGST-II genomic sequence, these biallelic markers representing useful tools in order to identify a statistically significant association between specific alleles of MGST-II gene and one or several disorders related to asthma and/or hepatotoxicity.

A first embodiment of the invention encompasses polynucleotides consisting of, consisting essentially of, or comprising a contiguous span of nucleotides of a sequence selected as an individual or in any combination from the group consisting of SEQ ID Nos. 1–38, 40–54, 56–353, 355–463, and 465–487, and the complements thereof; preferably SEQ ID Nos. 485–487, 494–531, 533–547, 549–846, 848–956, and 958–977, and the complements thereof; or the sequences described in any one or more of Tables 12, 13, 14, 15, 16, 17, and 18, and the complements thereof, wherein said contiguous span is at least 6, 8, 10, 12, 15, 20, 25, 30, 35, 40, 50, 75, 100, 200, 500, or 1000 nucleotides in length, to the extent that such a length is consistent with the lengths of the particular Sequence ID. The present invention also relates to polynucleotides hybridizing under stringent or intermediate conditions to a sequence selected from the group consisting of SEQ ID Nos. SEQ ID Nos. 1–38, 40–54, 56–353, 355–463, and 465–487, and the complements thereof; preferably SEQ ID Nos. 485–487, 494–531, 533–547, 549–846, 848–956, and 958–977, and the complements thereof. In addition, the polynucleotides of the invention encompass polynucleotides with any further limitation described in this disclosure, or those following, specified alone or in any combination: Said contiguous span may optionally include the DME-related biallelic marker in said sequence; Optionally either the original or the alternative allele of Table 13 may be specified as being present at said DME-related biallelic marker; Optionally either the first or the second allele of Table 12 or 14 may be specified as being present at said DME-related biallelic marker; Optionally, said polynucleotide may comprise, consists of, or consist essentially of a contiguous span which ranges in length from 8, 10, 12, 15, 18 or 20 to 25, 35, 40, 50, 60, 70, or 80 nucleotides, or be specified as being 12, 15, 18, 20, 25, 35, 40, or 50 nucleotides in length and including a DME-related biallelic marker of said sequence, and optionally the original allele of Table 13 is present at said biallelic marker; Optionally, said biallelic marker may be within 6, 5, 4, 3, 2, or 1 nucleotides of the center of said polynucleotide or at the center of said polynucleotide; Optionally, the 3' end of said contiguous span may be present at the 3' end of said polynucleotide; Optionally, biallelic marker may be present at the 3' end of said polynucleotide; Optionally, the 3' end of said polynucleotide may be located within or at least 2, 4, 6, 8, 10, 12, 15, 18, 20, 25, 50, 100, 250, 500, or 1000 nucleotides upstream of a DME-related biallelic marker in said sequence, to the extent that such a distance is consistent with the lengths of the particular Sequence ID; Optionally, the 3' end of said polynucleotide may be located 1 nucleotide upstream of a DME-related biallelic marker in said sequence; and Optionally, said polynucleotide may further comprise a label.

A second embodiment of the invention encompasses any polynucleotide of the invention attached to a solid support. In addition, the polynucleotides of the invention which are attached to a solid support encompass polynucleotides with any further limitation described in this disclosure, or those following, specified alone or in any combination: Optionally, said polynucleotides may be specified as attached individually or in groups of at least 2, 5, 8, 10, 12, 15, 20, or 25 distinct polynucleotides of the inventions to a single solid support; Optionally, polynucleotides other than those of the invention may attached to the same solid support as polynucleotides of the invention; Optionally, when multiple polynucleotides are attached to a solid support they may be attached at random locations, or in an ordered array; Optionally, said ordered array may be addressable.

A third embodiment of the invention encompasses the use of any polynucleotide for, or any polynucleotide for use in, determining the identity of one or more nucleotides at a DME-related biallelic marker. In addition, the polynucleotides of the invention for use in determining the identity of one or more nucleotides at a DME-related biallelic marker encompass polynucleotides with any further limitation described in this disclosure, or those following, specified alone or in any combination. Optionally, said DME-related biallelic marker may be in a sequence selected individually or in any combination from the group consisting of SEQ ID Nos. 1–38, 40–54, 56–353, 355–463, and 465–487, and the complements thereof; preferably SEQ ID Nos. 485–487, 494–531, 533–547, 549–846, 848–956, and 958–977, and the complements thereof; Optionally, said polynucleotide may comprise a sequence disclosed in the present specification; Optionally, said polynucleotide may consist of, or consist essentially of any polynucleotide described in the present specification; Optionally, said determining may be performed in a hybridization assay, sequencing assay, microsequencing assay, or an enzyme-based mismatch detection assay; Optionally, said polynucleotide may be attached to a solid support, array, or addressable array; Optionally, said polynucleotide may be labeled.

A fourth embodiment of the invention encompasses the use of any polynucleotide for, or any polynucleotide for use in, amplifying a segment of nucleotides comprising a DME-related biallelic marker. In addition, the polynucleotides of the invention for use in amplifying a segment of nucleotides comprising a DME-related biallelic marker encompass polynucleotides with any further limitation described in this disclosure, or those following, specified alone or in any combination: Optionally, said DME-related biallelic marker may be in a sequence selected individually or in any combination from the group consisting of SEQ ID Nos. 1–38, 40–54, 56–353, 355–463, and 465–487, and the complements thereof; preferably SEQ ID Nos. 485–487, 494–531, 533–547, 549–846, 848–956, and 958–977, and the complements thereof; Optionally, said DME-related biallelic marker may be selected individually or in any combination from the biallelic markers described in Table 11(A–B); Optionally, said DME-related biallelic marker may be selected from the biallelic markers found in Tables 19, 20, 21 and 22; Optionally, said DME-related biallelic marker may be selected from the following biallelic markers: 12-455-326, 12-453-429, 12-454-363, 12-441-233, 12-461-299, 12-426-154, 12-424-198, 12-716-295, 10-428-219, 12-720-80, 12-156-91, 12-140-134, 12-653-423, 10-471-84, 10-471-85, 10-470-25, 12-652-203, 12-637-219, 12-721-440, and 10-420-284; Optionally, said polynucleotide may comprise a sequence disclosed in the present specification; Optionally, said polynucleotide may consist of, or consist essentially of any polynucleotide described in the present specification; Optionally, said amplifying may be performed by a PCR or LCR. Optionally, said polynucleotide may be attached to a solid support, array, or addressable array. Optionally, said polynucleotide may be labeled.

A fifth embodiment of the invention encompasses methods of genotyping a biological sample comprising determining the identity of a nucleotide at a DME-related biallelic marker. In addition, the genotyping methods of the invention encompass methods with any further limitation described in this disclosure, or those following, specified alone or in any combination: Optionally, said DME-related biallelic marker may be in a sequence selected individually or in any combination from the group consisting of SEQ ID Nos. 1–38, 40–54, 56–353, 355–463, and 465–487, and the complements thereof; preferably SEQ ID Nos. 485–487, 494–531, 533–547, 549–846, 848–956, and 958–977, and the complements thereof; Optionally, said DME-related biallelic marker may be selected individually or in any combination from the biallelic markers described in Table 11(A–B); Optionally, said DME-related biallelic marker may be selected individually or in any combination from the biallelic markers described in Table 11(A–B); Optionally, said DME-related biallelic marker may be selected from the biallelic markers found in Tables 19, 20, 21 and 22; Optionally, said DME-related biallelic marker may be selected from the following biallelic markers: 12-455-326, 12-453-429, 12-454-363, 12-441-233, 12-461-299, 12-426-154, 12-424-198, 12-716-295, 10-428-219, 12-720-80, 12-156-91, 12-140-134, 12-653-423, 10-471-84, 10-471-85, 10-470-25, 12-652-203, 12-637-219, 12-721-440, and 10-420-284; Optionally, said method further comprises determining the identity of a second nucleotide at said biallelic marker, wherein said first nucleotide and second nucleotide are not base paired (by Watson & Crick base pairing) to one another; Optionally, said biological sample is derived from a single individual or subject; Optionally, said method is performed in vitro; Optionally, said biallelic marker is determined for both copies of said biallelic marker present in said individual's genome; Optionally, said biological sample is derived from multiple subjects or individuals; Optionally, said method further comprises amplifying a portion of said sequence comprising the biallelic marker prior to said determining step; Optionally, wherein said amplifying is performed by PCR, LCR, or replication of a recombinant vector comprising an origin of replication and said portion in a host cell; Optionally, wherein said determining is performed by a hybridization assay, sequencing assay, microsequencing assay, or an enzyme-based mismatch detection assay.

A sixth embodiment of the invention comprises methods of estimating the frequency of an allele in a population comprising genotyping individuals from said population for a DME-related biallelic marker and determining the proportional representation of said biallelic marker in said population. In addition, the methods of estimating the frequency of an allele in a population of the invention encompass methods with any further limitation described in this disclosure, or those following, specified alone or in any combination: Optionally, said DME-related biallelic marker may be in a sequence selected individually or in any combination from the group consisting of SEQ ID Nos. 1–38, 40–54, 56–353, 355–463, and 465–487, and the complements thereof; preferably SEQ ID Nos. 485–487, 494–531, 533–547, 549–846, 848–956, and 958–977, and the complements thereof; Optionally, said DME-related biallelic marker may be selected from the biallelic markers described in Table 11(A–B); Optionally, said DME-related biallelic marker may be selected individually or in any combination from the biallelic markers described in Table 11(A–B); Optionally, said DME-related biallelic marker may be selected from the biallelic markers found in Tables 19, 20, 21 and 22; Optionally, said DME-related biallelic marker may be selected from the following biallelic markers: 12-455-326, 12-453-429, 12-454-363, 12-441-233, 12-461-299, 12-426-154, 12-424-198, 12-716-295, 10-428-219, 12-720-80, 12-156-91, 12-140-134, 12-653-423, 10-471-84, 10-471-85, 10-470-25, 12-652-203, 12-637-219, 12-721-440, and 10-420-284; Optionally, determining the frequency of a biallelic marker allele in a population may be accomplished by determining the identity of the nucleotides for both copies of said biallelic marker present in the genome of each individual in said population and calculating the proportional representation of said nucleotide at said DME-related biallelic marker for the population; Optionally, determining the frequency of a biallelic marker allele in a population may be accomplished by performing a genotyping method on a pooled biological sample derived from a representative number of individuals, or each individual, in said population, and calculating the proportional amount of said nucleotide compared with the total.

A seventh embodiment of the invention comprises methods of detecting an association between an allele and a phenotype, comprising the steps of a) determining the frequency of at least one DME-related biallelic marker allele in a case (trait positive) population, b) determining the frequency of said DME-related biallelic marker allele in a control population and; c) determining whether a statistically significant association exists between said genotype and said phenotype. In addition, the methods of detecting an association between an allele and a phenotype of the invention encompass methods with any further limitation described in this disclosure, or those following, specified alone or in any combination: Optionally, said DME-related biallelic marker may be in a sequence selected individually or in any combination from the group consisting of SEQ ID Nos. 1–38, 40–54, 56–353, 355–463, and 465–487, and the complements thereof; preferably SEQ ID Nos. 485–487, 494–531, 533–547, 549–846, 848–956, and 958–977, and the complements thereof; Optionally, said DME-related biallelic marker may be selected from the biallelic markers described in Table 11(A–B); Optionally, said control population may be a trait negative population, or a random population; Optionally, said phenotype is a response to a drug, or a side effects to a drug, or a disease involving the metabolic conversion of xenobiotics; Optionally, the identity of the nucleotides at the biallelic markers in everyone of the following sequences: SEQ ID Nos. 1–38, 40–54, 56–353, 355–463, and 465–487; preferably SEQ ID Nos. 485–487, 494–531, 533–547, 549–846, 848–956, and 958–977 is determined in steps a) and b).

An eighth embodiment of the present invention encompasses methods of estimating the frequency of a haplotype for a set of biallelic markers in a population, comprising the steps of: a) genotyping each individual in said population for at least one DME-related biallelic marker, b) genotyping each individual in said population for a second biallelic marker by determining the identity of the nucleotides at said second biallelic marker for both copies of said second biallelic marker present in the genome; and c) applying a haplotype determination method to the identities of the nucleotides determined in steps a) and b) to obtain an estimate of said frequency. In addition, the methods of estimating the frequency of a haplotype of the invention encompass methods with any further limitation described in this disclosure, or those following, specified alone or in any combination: Optionally said haplotype determination method is selected from the group consisting of asymmetric PCR amplification, double PCR amplification of specific alleles, the Clark method, and an expectation maximization algorithm; Optionally, said second biallelic marker is a DME-related biallelic marker in a sequence selected from the group consisting of the biallelic markers of SEQ ID Nos.

1–38, 40–54, 56–353, 355–463, and 465–487, and the complements thereof; preferably SEQ ID Nos. 485–487, 494–531, 533–547, 549–846, 848–956, and 958–977, and the complements thereof; Optionally, said DME-related biallelic markers may be selected individually or in any combination from the biallelic markers described in Table 11(A–B); Optionally, said DME-related biallelic marker may be selected individually or in any combination from the biallelic markers described in Table 11(A–B); Optionally, said DME-related biallelic marker may be selected from the biallelic markers found in Tables 19, 20, 21 and 22; Optionally, said DME-related biallelic marker may be selected from the following biallelic markers: 12-455-326, 12-453-429, 12-454-363, 12-441-233, 12-461-299, 12-426-154, 12-424-198, 12-716-295, 10-428-219, 12-720-80, 12-156-91, 12-140-134, 12-653-423, 10-471-84, 10-471-85, 10-470-25, 12-652-203, 12-637-219, 12-721-440, and 10-420-284; Optionally, the identity of the nucleotides at the biallelic markers in everyone of the sequences of SEQ ID Nos. 1–38, 40–54, 56–353, 355–463, and 465–487; preferably SEQ ID Nos. 485–487, 494–531, 533–547, 549–846, 848–956, and 958–977 is determined in steps a) and b).

A ninth embodiment of the present invention encompasses methods of detecting an association between a haplotype and a phenotype, comprising the steps of: a) estimating the frequency of at least one haplotype in a trait positive population according to a method of estimating the frequency of a haplotype of the invention; b) estimating the frequency of said haplotype in a control population according to the method of estimating the frequency of a haplotype of the invention; and c) determining whether a statistically significant association exists between said haplotype and said phenotype. In addition, the methods of detecting an association between a haplotype and a phenotype of the invention encompass methods with any further limitation described in this disclosure, or those following, specified alone or in any combination: Optionally, said DME-related biallelic marker may be in a sequence selected individually or in any combination from the group consisting of SEQ ID Nos. 1–38, 40–54, 56–353, 355–463, and 465–487, and the complements thereof; preferably SEQ ID Nos. 485–487, 494–531, 533–547, 549–846, 848–956, and 958–977, and the complements thereof; Optionally, said DME-related biallelic markers may be selected individually or in any combination from the biallelic markers described in Table 11(A–B); Optionally, said DME-related biallelic marker may be selected from the biallelic markers found in Tables 19, 20, 21 and 22; Optionally, said DME-related biallelic marker may be selected from the following biallelic markers: 12-455-326, 12-453-429, 12-454-363, 12-441-233, 12-461-299, 12-426-154, 12-424-198, 12-716-295, 10-428-219, 12-720-80, 12-156-91, 12-140-134, 12-653-423, 10-471-84, 10-471-85, 10-470-25, 12-652-203, 12-637-219, 12-721-440, and 10-420-284; Optionally, said control population may be a trait negative population, or a random population; Optionally, said phenotype is a response to a drug, or a side effects to a drug, or a disease involving the metabolic conversion of xenobiotics; Optionally, the identity of the nucleotides at the biallelic markers in everyone of the following sequences: SEQ ID Nos. 1–38, 40–54, 56–353, 355–463, and 465–487; preferably SEQ ID Nos. 485–487, 494–531, 533–547, 549–846, 848–956, and 958–977 is determined in steps a) and b).

A tenth embodiment of the present invention is a method of administering a drug or a treatment comprising the steps of: a) obtaining a nucleic acid sample from an individual; b) determining the identity of the polymorphic base of at least one DME-related biallelic marker which is associated with a positive response to the treatment or the drug; or at least one biallelic DME-related biallelic marker which is associated with a negative response to the treatment or the drug; and c) administering the treatment or the drug to the individual if the nucleic acid sample contains said biallelic marker associated with a positive response to the treatment or the drug or if the nucleic acid sample lacks said biallelic marker associated with a negative response to the treatment or the drug. In addition, the methods of the present invention for administering a drug or a treatment encompass methods with any further limitation described in this disclosure, or those following, specified alone or in any combination: optionally, said DME-related biallelic marker may be in a sequence selected individually or in any combination from the group consisting of SEQ ID Nos. 1–38, 40–54, 56–353, 355–463, and 465–487, and the complements thereof; or preferably SEQ ID Nos. 485–487, 494–531, 533–547, 549–846, 848–956, 958–977, and the complements thereof; or more preferably SEQ ID Nos. 496, 498, 502, 506–508, 518, 524, 526, 530, 531, 534, 816, 838, 844–846, 850, 870, 873, and the complements thereof; Optionally, the administering step comprises administering the drug or the treatment to the individual if the nucleic acid sample contains said biallelic marker associated with a positive response to the treatment or the drug and the nucleic acid sample lacks said biallelic marker associated with a negative response to the treatment or the drug.

An eleventh embodiment of the present invention is a method of selecting an individual for inclusion in a clinical trial of a treatment or drug comprising the steps of: a) obtaining a nucleic acid sample from an individual; b) determining the identity of the polymorphic base of at least one DME-related biallelic marker which is associated with a positive response to the treatment or the drug, or at least one DME-related biallelic marker which is associated with a negative response to the treatment or the drug in the nucleic acid sample, and c) including the individual in the clinical trial if the nucleic acid sample contains said DME-related biallelic marker associated with a positive response to the treatment or the drug or if the nucleic acid sample lacks said biallelic marker associated with a negative response to the treatment or the drug. In addition, the methods of the present invention for selecting an individual for inclusion in a clinical trial of a treatment or drug encompass methods with any further limitation described in this disclosure, or those following, specified alone or in any combination: Optionally, said DME-related biallelic marker may be in a sequence selected individually or in any combination from the group consisting of SEQ ID Nos. 1–38, 40–54, 56–353, 355–463, and 465–487, and the complements thereof, or preferably SEQ ID Nos. 485–487, 494–531, 533–547, 549–846, 848–956, 958–977, and the complements thereof; or more preferably SEQ ID Nos. 496, 498, 502, 506–508, 518, 524, 526, 530, 531, 534, 816, 838, 844–846, 850, 870, 873, and the complements thereof; Optionally, the including step comprises administering the drug or the treatment to the individual if the nucleic acid sample contains said biallelic marker associated with a positive response to the treatment or the drug and the nucleic acid sample lacks said biallelic marker associated with a negative response to the treatment or the drug.

Additional embodiments are set forth in the Detailed Description of the Invention and in the Examples.

BRIEF DESCRIPTION OF THE TABLES

Table 11A is a chart containing a list of all of the DME-related biallelic markers for each gene with an indication of the gene for which the marker is in closest physical proximity, an indication of whether the markers have been validated by microsequencing (with a Y indicating that the markers have been validated by microsequencing and an N indicating that it has not), and an indication of the identity and frequency of the least common allele determined by genotyping (with a blank left to indicate that the frequency has not yet been reported for some markers). The frequencies were determined from DNA samples collected from a random US Caucasian population. When the marker was determined to be homozygous at the particular location for the random US Caucasian population, the homozygous bases were recorded in the "Genotyping Least Common Allele Frequency" column of Table 11A.

Table 11B contains all of the DME-related biallelic markers provided in Table 11A; however, they are provided in shorter, easier to search sequences of 47 nucleotides. Accordingly, Table 11A begins with SEQ ID No. 1 and ends with SEQ ID No. 484, while Table 11B begins with SEQ ID No. 494 and ends with SEQ ID No. 977 (SEQ ID Nos. 485–493 correspond to the genomic and protein sequences of the invention and are not repeated in Table 11B). Table 1 below contains the first five markers listed in the sequence listing and their corresponding SEQ ID numbers in Tables 11A and 11B to illustrate the relationship between Tables 11A and 11B:

TABLE 1

| BIALLELIC MARKER ID | SEQ ID NO. IN TABLE 11A | BIALLELIC MARKER POSITION IN SEQ ID NO. | SEQ ID NO. IN TABLE 11B | BIALLELIC MARKER POSITION IN SEQ ID NO. |
|---|---|---|---|---|
| 12-421-140 | 1 | 501 | 494 | 24 |
| 12-424-192 | 2 | 501 | 495 | 24 |
| 12-424-198 | 3 | 501 | 496 | 24 |
| 12-425-57 | 4 | 501 | 497 | 24 |
| 12-426-154 | 5 | 461 | 498 | 24 |

Table 11B is the same as Table 11A in that it is a list of all of the DME-related biallelic markers for each gene with an indication of the gene for which the marker is in closest physical proximity, an indication of whether the markers have been validated by microsequencing (with a Y indicating that the markers have been validated by microsequencing and an N indicating that it has not), and an indication of the identity and frequency of the least common allele determined by genotyping (with a blank left to indicate that the frequency has not yet been reported for some markers). However, the "Biallelic Marker Position in SEQ ID No." for all of the DME-related biallelic markers provided in Table 11B is position 24 (representing the midpoint of the 47 mers that make up Table 11B). The frequencies were determined from DNA samples collected from a random US Caucasian population.

Tables 12, 13, and 14 are charts containing lists of the DME-related biallelic markers. Each marker is described by indicating its SEQ ID, the biallelic marker ID, and the two most common alleles. Table 12 is a chart containing a list of biallelic markers surrounded by preferred sequences. In the column labeled, "POSITION RANGE OF PREFERRED SEQUENCE" of Table 12, regions of particularly preferred sequences are listed for each SEQ ID, which contain a DME-related biallelic marker, as well as particularly preferred regions of sequences that may not contain a DME-related biallelic marker but, which are in sufficiently close proximity to a DME-related biallelic marker to be useful as amplification or sequencing primers.

Table 15 is a chart listing particular preferred sequences that are useful for designing some of the primers and probes of the invention. Each sequence is described by indicating its Sequence ID and the positions of the first and last nucleotides (position range) of the particular sequence in the Sequence ID.

Table 16 is a chart listing microsequencing primers which have been used to genotype DME-related biallelic markers (indicated by an *) and other preferred microsequencing primers for use in genotyping DME-related biallelic markers. Each of the primers which falls within the strand of nucleotides included in the Sequence Listing are described by indicating their Sequence ID number and the positions of the first and last nucleotides (position range) of the primers in the Sequence ID. Since the sequences in the Sequence Listing are single stranded and half the possible microsequencing primers are composed of nucleotide sequences from the complementary strand, the primers that are composed of nucleotides in the complementary strand are described by indicating their SEQ ID numbers and the positions of the first and last nucleotides to which they are complementary (complementary position range) in the Sequence ID.

Table 17 is a chart listing amplification primers which have been used to amplify polynucleotides containing one or more DME-related biallelic markers. Each of the primers which falls within the strand of nucleotides included in the Sequence Listing are described by indicating their Sequence ID number and the positions of the first and last nucleotides (position range) of the primers in the Sequence ID. Since the sequences in the Sequence Listing are single stranded and half the possible amplification primers are composed of nucleotide sequences from the complementary strand, the primers that are composed of nucleotides in the complementary strand are defined by the SEQ ID numbers and the positions of the first and last nucleotides to which they are complementary (complementary position range) in the Sequence ID.

Table 18 is a chart listing preferred probes useful in genotyping DME-related biallelic markers by hybridization assays. The probes are generally 25-mers with a DME-related biallelic marker in the center position, and described by indicating their Sequence ID number and the positions of the first and last nucleotides (position range) of the probes in the Sequence ID. The probes complementary to the sequences in each position range in each Sequence ID are also understood to be a part of this preferred list even though they are not specified separately.

Table 19 is a chart containing a list of preferred MGST-II-related biallelic markers with an indication of the frequency of both alleles determined by genotyping. Frequencies were determined in a random US Caucasian population.

Table 20 is a chart containing a list of preferred ME1-related biallelic markers with an indication of the frequency of both alleles determined by genotyping. Frequencies were determined in a random US Caucasian population.

Table 21 is a chart containing a list of preferred UGT1A7-related biallelic markers with an indication of the frequency of both alleles determined by genotyping. Frequencies were determined in a random US Caucasian population and a random French Caucasian population.

Table 22 is a chart containing a list of preferred UGT2B4-related biallelic markers with an indication of the frequency of both alleles determined by genotyping. Frequencies were determined in a random US Caucasian population and a random French Caucasian population.

Table 23 is a chart showing the results of a haplotype analysis study demonstrating an association between asthma and MGST-II-related biallelic marker haplotypes.

Table 24 is a chart showing the results of a permutation test which evaluates the statistical significance of the results obtained for the MGST2 haplotype analysis.

Table 25 is a chart showing the results of a single point allelic association analysis conducted on individuals with side effects to treatment with the anti-asthmatic drug Zyflo™ (zileuton) and MGST-II related biallelic markers.

Table 26 is a chart showing the results of a haplotype analysis study demonstrating an association between side effects upon treatment with the anti-asthmatic drug Zyflo™ (zileuton) and MGST-II related biallelic marker haplotypes.

Table 27 is a table showing the results of a phenotypic permutation test which evaluates the statistical significance of the MGST-II haplotype analysis results.

Table 28 is a chart showing the results of a single point allelic association analysis conducted on individuals with side effects to treatment with the anti-asthmatic drug Zyflo™ (zileuton) and UGT1A7-related biallelic markers.

Table 29 is a chart showing the results of a haplotype analysis study demonstrating an association between side effects upon treatment with the anti-asthmatic drug Zyflo™ (zileuton) and UGT1A7-related biallelic marker haplotypes.

Table 30 is a chart showing the results of a permutation test which evaluates the statistical significance of the results obtained from the UGT1A7 haplotype analysis.

Table 31 is a chart showing the results of a single point allelic association analysis conducted on individuals with side effects to treatment with the anti-asthmatic drug Zyflo™ (zileuton) and UGT2B4-related biallelic markers.

Table 32 is a chart showing the results of a haplotype analysis study demonstrating an association between side effects upon treatment with the anti-asthmatic drug Zyflo™ (zileuton) and UGT2B4-related biallelic marker haplotypes.

Table 33 is a chart showing the results of a permutation test which evaluates the statistical significance of the results obtained from the UGT2B4 haplotype analysis.

BRIEF DESCRIPTION OF THE SEQUENCES PROVIDED IN THE SEQUENCE LISTING

SEQ ID Nos. 1–484 contain the nucleotide sequence of genomic DNA fragments located in the vicinity of the candidate genes.

SEQ ID No. 485 contains the genomic sequence of the MGST-II gene comprising the 5' regulatory region (upstream untranscribed region), the exons and introns, and the 3' regulatory region (downstream untranscribed region).

SEQ ID No. 486 contains a cDNA sequence of MGST-II.

SEQ ID No. 487 contains a cDNA sequence of MGST-II corresponding to an alternative messenger RNA which is due to alternative splicing joining exon 1 to exon 3 and resulting in the absence of exon 2.

SEQ ID No. 488 contains the amino acid sequence encoded by the cDNA of SEQ ID No. 486.

SEQ ID No. 489 contains the amino acid sequence encoded by the cDNA of SEQ ID No. 487.

SEQ ID No. 490 contains a partial cDNA sequence of MGST-II sequence corresponding to a cloned partial messenger RNA.

SEQ ID No. 491 contains a partial cDNA sequence of MGST-II sequence corresponding to a cloned partial messenger RNA.

SEQ ID No. 492 contains a primer containing the additional PU 5' sequence described further in Example 1.

SEQ ID No. 493 contains a primer containing the additional RP 5' sequence described further in Example 1.

SEQ ID Nos. 494–977 contain the nucleotide sequence of genomic DNA fragments located in the vicinity of the candidate genes. These sequences are in easier to search sequences of 47 nucleotides.

DETAILED DESCRIPTION OF THE INVENTION

Advantages of the Biallelic Markers of the Present Invention

The DME-related biallelic markers of the present invention offer a number of important advantages over other genetic markers such as RFLP (Restriction fragment length polymorphism) and VNTR (Variable Number of Tandem Repeats) markers.

The first generation of markers, were RFLPs, which are variations that modify the length of a restriction fragment. But methods used to identify and to type RFLPs are relatively wasteful of materials, effort, and time. The second generation of genetic markers were VNTRs, which can be categorized as either minisatellites or microsatellites. Minisatellites are tandemly repeated DNA sequences present in units of 5–50 repeats which are distributed along regions of the human chromosomes ranging from 0.1 to 20 kilobases in length. Since they present many possible alleles, their informative content is very high. Minisatellites are scored by performing Southern blots to identify the number of tandem repeats present in a nucleic acid sample from the individual being tested. However, there are only $10^4$ potential VNTRs that can be typed by Southern blotting. Moreover, both RFLP and VNTR markers are costly and time-consuming to develop and assay in large numbers.

Single nucleotide polymorphism or biallelic markers can be used in the same manner as RFLPs and VNTRs but offer several advantages. Single nucleotide polymorphisms are densely spaced in the human genome and represent the most frequent type of variation. An estimated number of more than $10^7$ sites are scattered along the $3 \times 10^9$ base pairs of the human genome. Therefore, single nucleotide polymorphism occur at a greater frequency and with greater uniformity than RFLP or VNTR markers which means that there is a greater probability that such a marker will be found in close proximity to a genetic locus of interest. Single nucleotide polymorphisms are less variable than VNTR markers but are mutationally more stable.

Also, the different forms of a characterized single nucleotide polymorphism, such as the biallelic markers of the present invention, are often easier to distinguish and can therefore be typed easily on a routine basis. Biallelic markers have single nucleotide based alleles and they have only two common alleles, which allows highly parallel detection and automated scoring. The biallelic markers of the present invention offer the possibility of rapid, high-throughput genotyping of a large number of individuals.

Biallelic markers are densely spaced in the genome, sufficiently informative and can be assayed in large numbers. The combined effects of these advantages make biallelic markers extremely valuable in genetic studies. Biallelic markers can be used in linkage studies in families, in allele sharing methods, in linkage disequilibrium studies in populations, in association studies of case-control populations. An important aspect of the present invention is that biallelic markers allow association studies to be performed to identify genes involved in complex traits. Association studies examine the frequency of marker alleles in unrelated case-and control-populations and are generally employed in the detection of polygenic or sporadic traits. Association studies may be conducted within the general population and are not limited to studies performed on related individuals in affected families (linkage studies). Biallelic markers in different genes can be screened in parallel for direct association with disease or response to a treatment. This multiple gene approach is a powerful tool for a variety of human genetic studies as it provides the necessary statistical power to examine the synergistic effect of multiple genetic factors on a particular phenotype, drug response, sporadic trait, or disease state with a complex genetic etiology.

Candidate Genes of the Present Invention

Different approaches can be employed to perform association studies: genome-wide association studies, candidate region association studies and candidate gene association studies. Genome-wide association studies rely on the screening of genetic markers evenly spaced and covering the entire genome. Candidate region association studies rely on the screening of genetic markers evenly spaced covering a region identified as linked to the trait of interest. The candidate gene approach is based on the study of genetic markers specifically derived from genes potentially involved in a biological pathway related to the trait of interest. In the present invention, genes involved in drug metabolism have been chosen as candidate genes. As mentioned above, these genes are highly relevant to pharmacogenetics because they are at the core of drug response, drug efficacy and toxicity, moreover, drug-metabolizing enzymes also determine an individuals susceptibility to exogenous chemicals and to a number of diseases associated with exposure to toxic or carcinogenic chemicals. The candidate gene analysis clearly provides a short-cut approach to the identification of genes and gene polymorphisms related to a particular trait when some information concerning the biology of the trait is available. However, it should be noted that all of the biallelic markers disclosed in the instant application can be employed as part of genome-wide association studies or as part of candidate region association studies and such uses are specifically contemplated in the present invention and claims. All of the markers are known to be in close proximity to the genes with which they are listed in Table 11(A–B). For a portion of the markers, the precise position of the marker with respect to the various coding and non-coding elements of the genes has also been determined.

The following is a table of abbreviations for the candidate genes as they appear throughout the specification:

TABLE 2

| Candidate Gene | Abbreviation |
|---|---|
| Microsomal glutathione S-transferase II | MGST2 or MGST II |
| Malate decarboxylase enzyme | DMF or ME1 |
| Cytochrome P450 1A2 | CYP1A2 |
| Cytochrome P450 2C8 | CYP2C8 |
| Cytochrome P450 2C9 | CYP2C9 |
| Cytochrome P450 2C18 | CYP2C18 |
| Cytochrome P450 3A4-3A7 | CYP3A4-CYP3A7 |
| Cytochrome P450 3A7 | CYP3A7 |
| Flavin-containing monooxygenases | FMO |
| Glutathione reductase | GSHR |
| Glutathione synthase | GSHS |
| γ-glutamylcysteine synthetase | GLCL |
| γ-glutamyltransferase 5 | GGT5 |
| Dipeptidase | DP |
| Glucose 6-phosphate dehydrogenase | G6PDH |
| Phosphogluconate dehydrogenase | PGDH |
| Uridine diphosphate glucoronosyl transferase 1A7 | UGT1A7 |
| Uridine diphosphate glucoronosyl transferase B4 | UGT2B4 |

TABLE 2-continued

| Candidate Gene | Abbreviation |
|---|---|
| Uridine diphosphate glucoronosyl transferase B7 | UGT2B7 |
| Uridine diphosphate glucoronosyl transferase B10 | UGT2B10 |
| Uridine diphosphate glucoronosyl transferase B15 | UGT2B15 |

Definitions

As used interchangeably herein, the terms "nucleic acids," "oligonucleotides" and "polynucleotides" include RNA, DNA, or RNA/DNA hybrid sequences of more than one nucleotide in either single chain or duplex form. The term "nucleotide" as used herein as an adjective to describe molecules comprising RNA, DNA, or RNA/DNA hybrid sequences of any length in single-stranded or duplex form. The term "nucleotide" is also used herein as a noun to refer to individual nucleotides or varieties of nucleotides, meaning a molecule, or individual unit in a larger nucleic acid molecule, comprising a purine or pyrimidine, a ribose or deoxyribose sugar moiety, and a phosphate group, or phosphodiester linkage in the case of nucleotides within an oligonucleotide or polynucleotide. Although the term "nucleotide" is also used herein to encompass "modified nucleotides" which comprise at least one modifications (a) an alternative linking group, (b) an analogous form of purine, (c) an analogous form of pyrimidine, or (d) an analogous sugar, for examples of analogous linking groups, purine, pyrimidines, and sugars see for example PCT publication No. WO 95/04064, the disclosure of which is incorporated herein by reference in its entirety. However, the polynucleotides of the invention are preferably comprised of greater than 50% conventional deoxyribose nucleotides, and most preferably greater than 90% conventional deoxyribose nucleotides. The polynucleotide sequences of the invention may be prepared by any known method, including synthetic, recombinant, ex vivo generation, or a combination thereof, as well as utilizing any purification methods known in the art.

Throughout the present specification, the expression "nucleotide sequence" may be employed to designate indifferently a polynucleotide or a nucleic acid. More precisely, the expression "nucleotide sequence" encompasses the nucleic material itself and is thus not restricted to the sequence information (i.e. the succession of letters chosen among the four base letters) that biochemically characterizes a specific DNA or RNA molecule.

The term "polypeptide" refers to a polymer of amino without regard to the length of the polymer; thus, peptides, oligopeptides, and proteins are included within the definition of polypeptide. This term also does not specify or exclude prost-expression modifications of polypeptides, for example, polypeptides which include the covalent attachment of glycosyl groups, acetyl groups, phosphate groups, lipid groups and the like are expressly encompassed by the term polypeptide. Also included within the definition are polypeptides which contain one or more analogs of an amino acid (including, for example, non-naturally occurring amino acids, amino acids which only occur naturally in an unrelated biological system, modified amino acids from mammalian systems etc.), polypeptides with substituted linkages, as well as other modifications known in the art, both naturally occurring and non-naturally occurring.

The term "recombinant polypeptide" is used herein to refer to polypeptides that have been artificially designed and which comprise at least two polypeptide sequences that are not found as contiguous polypeptide sequences in their initial natural environment, or to refer to polypeptides which have been expressed from a recombinant polynucleotide.

As used herein, the term "isolated" requires that the material be removed from its original environment (e.g., the natural environment if it is naturally occurring). For example, a naturally occurring polynucleotide present in a living animal is not isolated, but the same polynucleotide, separated from some or all of the coexisting materials in the natural system, is isolated. Specifically excluded from the definition of "isolated" are: naturally occurring chromosomes (e.g., chromosome spreads) artificial chromosome libraries, genomic libraries, and cDNA libraries that exist either as an in vitro nucleic acid preparation or as a transfected/transformed host cell preparation, wherein the host cells are either an in vitro heterogeneous preparation or plated as a heterogeneous population of single colonies. Also specifically excluded are the above libraries wherein the 5' EST makes up less than 5% of the number of nucleic acid inserts in the vector molecules. Further specifically excluded are whole cell genomic DNA or whole cell RNA preparations (including said whole cell preparations which are mechanically sheared or enzymaticly digested). Further specifically excluded are the above whole cell preparations as either an in vitro preparation or as a heterogeneous mixture separated by electrophoresis (including blot transfers of the same) wherein the polynucleotide of the invention have not been further separated from the heterologous polynucleotides in the electrophoresis medium (e.g., further separating by excising a single band from a heterogeneous band population in an agarose gel or nylon blot).

As used herein, the term "purified" does not require absolute purity; rather, it is intended as a relative definition. Individual 5' EST clones isolated from a cDNA library have been conventionally purified to electrophoretic homogeneity. The sequences obtained from these clones could not be obtained directly either from the library or from total human DNA. The cDNA clones are not naturally occurring as such, but rather are obtained via manipulation of a partially purified naturally occurring substance (messenger RNA). The conversion of mRNA into a cDNA library involves the creation of a synthetic substance (cDNA) and pure individual cDNA clones can be isolated from the synthetic library by clonal selection. Thus, creating a cDNA library from messenger RNA and subsequently isolating individual clones from that library results in an approximately $10^4$–$10^6$ fold purification of the native message. Purification of starting material or natural material to at least one order of magnitude, preferably two or three orders, and more preferably four or five orders of magnitude is expressly contemplated. Alternatively, purification may be expressed as "at least" a percent purity relative to heterologous polynucleotides (DNA, RNA or both). As a preferred embodiment, the polynucleotides of the present invention are at least; 10%, 20%, 30%, 40%, 50%, 60%, 70%, 80%, 90%, 95%, 96%, 96%, 98%, 99%, or 100% pure relative to heterologous polynucleotides. As a further preferred embodiment the polynucleotides have an "at least" purity ranging from any number, to the thousandth position, between 90% and 100% (e.g., 5' EST at least 99.995% pure) relative to heterologous polynucleotides. Additionally, purity of the polynucleotides may be expressed as a percentage (as described above) relative to all materials and compounds other than the carrier solution. Each number, to the thousandth position, may be claimed as individual species of purity.

As used herein, the term "non-human animal" refers to any non-human vertebrate, birds and more usually mammals, preferably primates, farm animals such as swine, goats, sheep, donkeys, and horses, rabbits or rodents, more preferably rats or mice. As used herein, the term "animal" is used to refer to any vertebrate, preferable a mammal. Both the terms "animal" and "mammal" expressly embrace human subjects unless preceded with the term "non-human".

The term "primer" denotes a specific oligonucleotide sequence which is complementary to a target nucleotide sequence and used to hybridize to the target nucleotide sequence. A primer serves as an initiation point for nucleotide polymerization catalyzed by either DNA polymerase, RNA polymerase or reverse transcriptase.

The term "probe" denotes a defined nucleic acid segment (or nucleotide analog segment, e.g., polynucleotide as defined herein) which can be used to identify a specific polynucleotide sequence present in samples, said nucleic acid segment comprising a nucleotide sequence complementary of the specific polynucleotide sequence to be identified.

The terms "trait" and "phenotype" are used interchangeably herein and refer to any visible, detectable or otherwise measurable property of an organism such as symptoms of, or susceptibility to a disease for example. Typically the terms "trait" or "phenotype" are used herein to refer to symptoms of, or susceptibility to a disease; or to refer to an individual's response to a drug; or to refer to symptoms of, or susceptibility to side effects to a drug. In addition, the terms "trait" or "phenotype" may be used herein to refer to symptoms of, or susceptibility to a disease involving arachidonic acid metabolism; or to refer to an individual's response to an agent acting on arachidonic acid metabolism; or to refer to symptoms of, or susceptibility to side effects to an agent acting on arachidonic acid metabolism.

The term "allele" is used herein to refer to variants of a nucleotide sequence. A biallelic polymorphism has two forms. Typically the first identified allele is designated as the original allele whereas other alleles are designated as alternative alleles. Diploid organisms may be homozygous or heterozygous for an allelic form.

The term "heterozygosity rate" is used herein to refer to the incidence of individuals in a population, which are heterozygous at a particular allele. In a biallelic system the heterozygosity rate is on average equal to $2P_a(1-P_a)$, where $P_a$ is the frequency of the least common allele. In order to be useful in genetic studies a genetic marker should have an adequate level of heterozygosity to allow a reasonable probability that a randomly selected person will be heterozygous.

The term "genotype" as used herein refers the identity of the alleles present in an individual or a sample. In the context of the present invention a genotype preferably refers to the description of the biallelic marker alleles present in an individual or a sample. The term "genotyping" a sample or an individual for a biallelic marker consists of determining the specific allele or the specific nucleotide carried by an individual at a biallelic marker.

The term "mutation" as used herein refers to a difference in DNA sequence between or among different genomes or individuals which has a frequency below 1%.

The term "haplotype" refers to a combination of alleles present in an individual or a sample. In the context of the present invention a haplotype preferably refers to a combination of biallelic marker alleles found in a given individual and which may be associated with a phenotype.

The term "polymorphism" as used herein refers to the occurrence of two or more alternative genomic sequences or alleles between or among different genomes or individuals. "Polymorphic" refers to the condition in which two or more variants of a specific genomic sequence can be found in a population. A "polymorphic site" is the locus at which the variation occurs. A single nucleotide polymorphism is a single base pair change. Typically a single nucleotide polymorphism is the replacement of one nucleotide by another nucleotide at the polymorphic site. Deletion of a single nucleotide or insertion of a single nucleotide, also give rise to single nucleotide polymorphisms. In the context of the present invention "single nucleotide polymorphism" preferably refers to a single nucleotide substitution. Typically, between different genomes or between different individuals, the polymorphic site may be occupied by two different nucleotides.

The terms "biallelic polymorphism" and "biallelic marker" are used interchangeably herein to refer to a polymorphism having two alleles at a fairly high frequency in the population, preferably a single nucleotide polymorphism. A "biallelic marker allele" refers to the nucleotide variants present at a biallelic marker site. Typically the frequency of the less common allele of the biallelic markers of the present invention has been validated to be greater than 1%, preferably the frequency is greater than 10%, more preferably the frequency is at least 20% (i.e. heterozygosity rate of at least 0.32), even more preferably the frequency is at least 30% (i.e. heterozygosity rate of at least 0.42). A biallelic marker wherein the frequency of the less common allele is 30% or more is termed a "high quality biallelic marker."

The location of nucleotides in a polynucleotide with respect to the center of the polynucleotide are described herein in the following manner. When a polynucleotide has an odd number of nucleotides, the nucleotide at an equal distance from the 3' and 5' ends of the polynucleotide is considered to be "at the center" of the polynucleotide, and any nucleotide immediately adjacent to the nucleotide at the center, or the nucleotide at the center itself is considered to be "within 1 nucleotide of the center." With an odd number of nucleotides in a polynucleotide any of the five nucleotides positions in the middle of the polynucleotide would be considered to be "within 2 nucleotides of the center, and so on. When a polynucleotide has an even number of nucleotides, there would be a bond and not a nucleotide at the center of the polynucleotide. Thus, either of the two central nucleotides would be considered to be "within 1 nucleotide of the center" and any of the four nucleotides in the middle of the polynucleotide would be considered to be "within 2 nucleotides of the center", and so on. For polymorphisms which involve the substitution, insertion or deletion of 1 or more nucleotides, the polymorphism, allele or biallelic marker is "at the center" of a polynucleotide if the difference between the distance from the substituted, inserted, or deleted polynucleotides of the polymorphism and the 3' end of the polynucleotide, and the distance from the substituted, inserted, or deleted polynucleotides of the polymorphism and the 5' end of the polynucleotide is zero or one nucleotide. If this difference is 0 to 3, then the polymorphism is considered to be "within 1 nucleotide of the center." If the difference is 0 to 5, the polymorphism is considered to be "within 2 nucleotides of the center." If the difference is 0 to 7, the polymorphism is considered to be "within 3 nucleotides of the center," and so on. For polymorphisms which involve the substitution, insertion or deletion of 1 or more nucleotides, the polymorphism, allele or biallelic marker is "at the center" of a polynucleotide if the difference between the distance from the substituted, inserted, or deleted polynucleotides of the polymorphism and the 3' end of the polynucleotide, and the distance from the substituted, inserted, or deleted polynucleotides of the polymorphism and the 5' end of the polynucleotide is zero or one nucleotide. If this difference is 0 to 3, then the polymorphism is considered to be "within 1 nucleotide of the center." If the difference is 0 to 5, the polymorphism is considered to be "within 2 nucleotides of the center." If the difference is 0 to 7, the polymorphism is considered to be "within 3 nucleotides of the center," and so on.

The term "upstream" is used herein to refer to a location which, is toward the 5' end of the polynucleotide from a specific reference point.

The terms "base paired" and "Watson & Crick base paired" are used interchangeably herein to refer to nucleotides which can be hydrogen bonded to one another be virtue of their sequence identities in a manner like that found in double-helical DNA with thymine or uracil residues linked to adenine residues by two hydrogen bonds and cytosine and guanine residues linked by three hydrogen bonds (See Stryer, L., *Biochemistry*, 4th edition, 1995).

The terms "complementary" or "complement thereof" are used herein to refer to the sequences of polynucleotides which is capable of forming Watson & Crick base pairing with another specified polynucleotide throughout the entirety of the complementary region. This term is applied to pairs of polynucleotides based solely upon their sequences and not any particular set of conditions under which the two polynucleotides would actually bind.

A "promoter" refers to a DNA sequence recognized by the synthetic machinery of the cell required to initiate the specific transcription of a gene.

A sequence which is "operably linked" to a regulatory sequence such as a promoter means that said regulatory element is in the correct location and orientation in relation to the nucleic acid to control RNA polymerase initiation and expression of the nucleic acid of interest.

As used herein, the term "operably linked" refers to a linkage of polynucleotide elements in a functional relationship. For instance, a promoter or enhancer is operably linked to a coding sequence if it affects the transcription of the coding sequence. More precisely, two DNA molecules (such as a polynucleotide containing a promoter region and a polynucleotide encoding a desired polypeptide or polynucleotide) are said to be "operably linked" if the nature of the linkage between the two polynucleotides does not (1) result in the introduction of a frame-shift mutation or (2) interfere with the ability of the polynucleotide containing the promoter to direct the transcription of the coding polynucleotide.

The terms "disease involving the metabolic conversion of xenobiotics" refers to susceptibility to a condition or to a condition linked to any of the genes listed in Table 11 (A–B). "Disease involving the metabolic conversion of xenobiotics" further refers to a condition involving the biotransformation of drugs and other xenobiotics such as environmental chemicals, food toxins, plant metabolites, carcinogens and industrial chemicals. Such conditions include susceptibility to the toxic or carcinogenic effect of exogenous compounds. "Disease involving the metabolic conversion of xenobiotics" also refers to disorders in the metabolism of some endogenous compounds such as the metabolism of steroids, vitamins, fatty acids and eicosanoids such as leukotrienes involving any of the drug-metabolizing enzymes shown in Table 11(A–B). "Disease involving the metabolic conversion of xenobiotics" includes, but is not limited to, disorders involving the cytochrome P450 enzyme family, the flavin containing monooxygenases, glucoronidation, the metabolism of glutathione, the pentose pathway and the generation of NADPH.

The term "disease involving arachidonic acid metabolism" refers to a condition linked to disturbances in expression, production or cellular response to eicosanoids such as prostaglandins, thromboxanes, prostacyclins, leukotrienes or hydroperoxyeicosaetrenoic acids. A disease involving arachidonic acid metabolism further refers to a condition involving one or several enzymes of the distinct enzyme systems contributing to arachidonate metabolism including particularly the 5-lipoxygenase pathway. "Diseases involving arachidonic acid metabolism" also include chronic inflammatory diseases, acute allergic inflammation and inflammatory conditions such as pain, fever, hypersensitivity, asthma, psoriasis and arthritis. "Diseases involving arachidonic acid metabolism" also include disorders in platelet function, blood pressure, thrombosis, renal function, host defense mechanism, hemostasis, smooth muscle tone, male infertility, primary dysmenorrhea, disorders in parturition, and disorders in tissue injury repair, as well as disorders in cellular function and development. "Diseases involving arachidonic acid metabolism" also include diseases such as gastrointestinal ulceration, coronary and cerebrovascular syndromes, glomerular immune injury and cancer. Preferably the terms "disease involving arachidonic acid metabolism" refer to a disease including diseases such as cancer, prostate cancer, breast cancer, psoriasis and inflammatory diseases. Preferably the terms "disease involving arachidonic acid metabolism" refer to a disease involving the 5-lipoxygenase pathway and the biosynthesis of the leukotrienes. More preferably the terms "disease involving arachidonic acid metabolism" refer to a disease involving the synthesis of leukotriene C4 (LTC4) and refers to disturbances in expression, activity or function of the human MGST-II enzyme.

As used herein the term "DME-related biallelic marker" relates to a set of biallelic markers located in or in the vicinity of the genes disclosed in Table 11(A–B) and further relates to biallelic markers in linkage disequilibrium with the biallelic markers disclosed in Table 11(A–B). The term DME-related biallelic marker encompasses all of the biallelic markers disclosed in Table 11(A–B).

The invention also concerns MGST-II-related biallelic markers. The term "MGST-II-related biallelic marker" is used interchangeably herein to relate to all biallelic markers in linkage disequilibrium with the biallelic markers of the MGST-II gene. The term MGST-II-related biallelic marker includes both the genic and non-genic biallelic markers described in Table 3.

The term "non-genic" is used herein to describe MGST-II-related biallelic markers, as well as polynucleotides and primers which occur outside the nucleotide positions shown in the human MGST-II genomic sequence of SEQ ID No. 485. The term "genic" is used herein to describe MGST-II-related biallelic markers as well as polynucleotides and primers which do occur in the nucleotide positions shown in the human MGST-II genomic sequence of SEQ ID No. 485.

The terms "agent acting on arachidonic acid metabolism" refers to a drug or a compound modulating the activity or concentration of one or several enzymes of the distinct enzyme systems contributing to arachidonate metabolism including particularly the 5-lipoxygenase pathway. "Agent acting on arachidonic acid metabolism" also refers to compounds modulating the formation and action of the eicosanoids including particularly the leukotrienes.

The terms "response to a drug" refer to drug efficacy, including but not limited to ability to metabolize a therapeutic compound, to the ability to convert a pro-drug to an active drug, and to the pharmacokinetics (absorption, distribution, elimination) and the pharmacodynamics (receptor-related) of a drug in an individual.

The terms "response to an agent acting on arachidonic acid metabolism" refer to drug efficacy, including but not limited to ability to metabolize a compound, to the ability to convert a pro-drug to an active drug, and to the pharmacokinetics (absorption, distribution, elimination) and the pharmacodynamics (receptor-related) of a drug in an individual.

The terms "side effects to a drug" refer to adverse effects of therapy resulting from extensions of the principal pharmacological action of the drug or to idiosyncratic adverse reactions resulting from an interaction of the drug with unique host factors. "Side effects to a drug" include, but are not limited to, adverse reactions such as dermatologic, hematologic or hepatologic toxicities and further includes gastric and intestinal ulceration, disturbance in platelet function, renal injury, generalized urticaria, bronchoconstriction, hypotension, and shock.

The terms "side effects to an agent acting on arachidonic acid metabolism" refer to adverse effects of therapy resulting from extensions of the principal pharmacological action of the drug or to idiosyncratic adverse reactions resulting from an interaction of the drug with unique host factors. The terms "side effects to an agent acting on arachidonic acid metabolism" include, but are not limited to, adverse reactions such as dermatologic, hematologic or hepatologic toxicities.

The term "sequence described in Table 11(A–B)" is used herein to refer to the entire collection of nucleotide sequences or any individual sequence defined in Table 11(A–B). The SEQ ID that contains each "sequence described in Table 11(A–B)" is provided in the column labeled, "SEQ ID NO." The column labeled "Gene" indicates the gene for which the marker is in closest physical proximity, an indication of whether the markers have been validated by microsequencing (with a Y indicating that the markers have been validated by microsequencing and an N indicating that it has not), and an indication of the identity and frequency of the least common allele determined by genotyping (with a blank left to indicate that the frequency has not yet been reported for some markers). The frequencies were determined from DNA samples collected from a random US Caucasian population.

The term "sequence described in Table 11B" is used herein to refer to the entire collection of nucleotide sequences or any individual sequence defined in Table 11B. The SEQ ID that contains each "sequence described in Table 11B" is provided in the column labeled, "SEQ ID NO." The column labeled "Gene" indicates the gene for which the marker is in closest physical proximity, an indication of whether the markers have been validated by microsequencing (with a Y indicating that the markers have been validated by microsequencing and an N indicating that it has not), and an indication of the identity and frequency of the least common allele determined by genotyping (with a blank left to indicate that the frequency has not yet been reported for some markers). The frequencies were determined from DNA samples collected from a random US Caucasian population. The "Biallelic Marker location in SEQ ID No." indicates the biallelic marker location within the 47 nucleotide sequence. In Table 11B, this location is 24 for all of the markers.

The term "sequence described in Table 12" is used herein to refer to the entire collection of nucleotide sequences or any individual sequence defined in Table 12. The SEQ ID that contains each "sequence described in Table 12" is provided in the column labeled, "SEQ ID NO." The range of nucleotide positions within the Sequence ID of which each sequence consists is provided in the same row as the Sequence ID in a column labeled, "POSITION RANGE OF PREFERRED SEQUENCE". It should be noted that some of the Sequence ID numbers have multiple sequence ranges listed, because they contain multiple "sequences described in Table 12." Unless otherwise noted the term "sequence described in Table 12" is to be construed as encompassing sequences that contain either of the two alleles listed in the columns labeled, "$1^{ST}$ ALLELE" and "$2^{ND}$ ALLELE" at the position identified in field <222> of the allele feature in the appended Sequence Listing for each Sequence ID number referenced in Table 12.

The term "sequence described in Table 13" is used herein to refer to the entire collection of nucleotide sequences or any individual sequence defined in Table 13. Unless otherwise noted, the "sequences described in Table 13" consist of the entire sequence of each Sequence ID provided in the column labeled, "SEQ ID NO." Also unless otherwise noted the term "sequence described in Table 13" is to be construed as encompassing sequences that contain either of the two alleles listed in the columns labeled, "ORIGINAL ALLELE" and "ALTERNATIVE ALLELE" at the position identified in field <222> of the allele feature in the appended Sequence Listing for each Sequence ID number referenced in Table 13.

The term "sequence described in Table 14" is used herein to refer to the entire collection of nucleotide sequences or any individual sequence defined in Table 14. Unless otherwise noted, the "sequences described in Table 14" consist of the entire sequence of each Sequence ID provided in the column labeled, "SEQ ID NO." Also unless otherwise noted the term "sequence described in Table 14" is to be construed as encompassing sequences that contain either of the two alleles listed in the columns labeled, "$1^{ST}$ ALLELE" and "$2^{ND}$ ALLELE" at the position identified in field <222> of the allele feature in the appended Sequence Listing for each Sequence ID number referenced in Table 14.

The term "sequence described in Table 15" is used herein to refer to the entire collection of nucleotide sequences or any individual sequence defined in Table 15. The SEQ ID that contains each "sequence described in Table 15" is provided in the column labeled, "SEQ ID NO." The range of nucleotide positions within the Sequence ID of which each sequence consists is provided in the same row as the Sequence ID in a column labeled, "POSITION RANGE OF PREFERRED SEQUENCE". It should be noted that some of the Sequence ID numbers have multiple sequence ranges listed, because they contain multiple "sequences described in Table 15."

The term "sequence described in Table 16" is used herein to refer to the entire collection of nucleotide sequences or any individual sequence defined in Table 16. The SEQ ID that contains each "sequence described in Table 16" is provided in the column labeled, "SEQ ID" The range of nucleotide positions within the Sequence ID of which half of the sequences consists is provided in the same row as the Sequence ID in a column labeled, "POSITION RANGE OF MICROSEQUENCING PRIMERS". The remaining half of the sequences described in Table 16 are complementary to the range of nucleotide positions within the Sequence ID provided in the same row as the Sequence ID in a column labeled, "COMPLEMENTARY POSITION RANGE OF MICROSEQUENCING PRIMERS".

The term "sequence described in Table 17" is used herein to refer to the entire collection of nucleotide sequences or any individual sequence defined in Table 17. The SEQ ID that contains each "sequence described in Table 17" is provided in the column labeled, "SEQ ID" The range of nucleotide positions within the Sequence ID of which half of the sequences consists is provided in the same row as the Sequence ID in a column labeled, "POSITION RANGE OF AMPLIFICATION PRIMERS". The remaining half of the sequences described in Table 17 are complementary to the range of nucleotide positions within the Sequence ID provided in the same row as the Sequence ID in a column labeled, "COMPLEMENTARY POSITION RANGE OF AMPLIFICATION PRIMERS".

The term "sequence described in Table 18" is used herein to refer to the entire collection of nucleotide sequences or any individual sequence defined in Table 18. The SEQ ID that contains each "sequence described in Table 18" is provided in the column labeled, "SEQ ID". The range of nucleotide positions within the Sequence ID of which each sequence consists is provided in the same row as the Sequence ID in a column labeled, "POSITION RANGE OF PROBES". The sequences which are complementary to the ranges listed in the column labeled, "POSITION RANGE OF PROBES" are also encompassed by the term, "sequence described in Table 18." Unless otherwise noted the term "sequence described in Table 18" is to be construed as encompassing sequences that contain either of the two alleles listed in the allele feature in the sequence listing.

The terms "biallelic marker described in Table" and "allele described in Table" are used herein to refer to any or all alleles which are listed in the allele feature in the appended Sequence Listing for each Sequence ID number referenced in the particular Table being mentioned.

Variants and Fragments

The invention also relates to variants and fragments of the polynucleotides described herein, particularly of a MGST-II gene containing one or more biallelic markers according to the invention.

Variants of polynucleotides, as the term is used herein, are polynucleotides that differ from a reference polynucleotide. A variant of a polynucleotide may be a naturally occurring variant such as a naturally occurring allelic variant, or it may be a variant that is not known to occur naturally. Such non-naturally occurring variants of the polynucleotide may be made by mutagenesis techniques, including those applied to polynucleotides, cells or organisms. Generally, differences are limited so that the nucleotide sequences of the reference and the variant are closely similar overall and, in many regions, identical. Variants of polynucleotides according to the invention include, without being limited to, nucleotide sequences which are at least 95% identical, preferably at least 99% identical, more particularly at least 99.5% identical, and most preferably at least 99.8% identical to a polynucleotide selected from the group consisting of the polynucleotides of a sequence from any sequence in the Sequence Listing as well as sequences which are complementary thereto or to any polynucleotide fragment of at least 8 consecutive nucleotides of a sequence from any sequence in the Sequence Listing. Nucleotide changes present in a variant polynucleotide may be silent, which means that they do not alter the amino acids encoded by the polynucleotide. However, nucleotide changes may also result in amino acid substitutions, additions, deletions, fusions and truncations in the polypeptide encoded by the reference sequence. The substitutions, deletions or additions may involve one or more nucleotides. The variants may be altered in coding or non-coding regions or both. Alterations in the coding regions may produce conservative or non-conservative amino acid substitutions, deletions or additions. In the context of the present invention, particularly preferred embodiments are those in which the polynucleotides encode polypeptides which retain substantially the same biological function or activity as the mature MGST-II protein, or those in which the polynucleotides encode polypeptides which maintain or increase a particular biological activity, while reducing a second biological activity. A polynucleotide fragment is a polynucleotide having a sequence that is entirely the same as part but not all of a given nucleotide sequence, preferably the nucleotide sequence of a MGST-II gene, and variants thereof. The fragment can be a portion of an exon or of an intron of a MGST-II gene. It can also be a portion of the regulatory regions of MGST-II, preferably of the promoter sequence of the MGST-II gene. Such fragments may be "free-standing", i.e. not part of or fused to other polynucleotides, or they may be comprised within a single larger polynucleotide of which they form a part or region. Indeed, several of these fragments may be present within a single larger polynucleotide.

Identity Between Nucleic Acids or Polypeptides

The terms "percentage of sequence identity" and "percentage homology" are used interchangeably herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Homology is evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, *Proc. Natl. Acad. Sci.* 85(8):2444–2448, 1988; Altschul et al., *J. Mol. Biol.* 215(3): 403–410,1990; Thompson et al., *Nucleic Acids Res.* 22(2): 4673–4680, 1994; Higgins et al., *Methods Enzymol.* 266:383–402, 1996; Altschul et al., *Nature Genetics* 3:266–272, 1993, the disclosures of which are incorporated herein by reference in their entireties). In a particularly preferred embodiment, protein and nucleic acid sequence homologies are evaluated using the Basic Local Alignment Search Tool ("BLAST") which is well known in the art (See, e.g., Karlin and Altschul,. *Proc. Natl. Acad. Sci. USA* 87:2267–2268, 1990; Altschul et al., *J. Mol. Biol.* 215(3): 403–410, 1990; Altschul et al., *Nature Genetics* 3:266–272, 1993; Altschul et al., *Nuc. Acids Res.* 25:3389–3402, 1997, the disclosures of which are incorporated herein by reference in their entireties). In particular, five specific BLAST programs are used to perform the following task:

(1) BLASTP and BLAST3 compare an amino acid query sequence against a protein sequence database;

(2) BLASTN compares a nucleotide query sequence against a nucleotide sequence database;

(3) BLASTX compares the six-frame conceptual translation products of a query nucleotide sequence (both strands) against a protein sequence database;

(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., *Science* 256:1443–1445, 1992; Henikoff and Henikoff, *Proteins* 17:49–61, 1993, the disclosures of which are incorporated herein by reference in their entireties). Less preferably, the PAM or PAM250 matrices may also be used (See, e.g., Schwartz and Dayhoff, eds., *Matrices for Detecting Distance Relationships: Atlas of Protein Sequence and Structure, Washington:National Biomedical Research Foundation,* 1978, the disclosure of which is incorporated herein by reference in its entirety). The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, 1990).

Stringent Hybridization Conditions

By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 $\mu$g/ml denatured salmon sperm DNA. Filters are hybridized for 48 h at 65° C., the preferred hybridization temperature, in prehybridization mixture containing 100 $\mu$g/ml denatured salmon sperm DNA and 5–20× $10^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. Other conditions of high stringency which may be used are well known in the art and as cited in Sambrook et al., 1989; and Ausubel et al., 1989. These hybridization conditions are suitable for a nucleic acid molecule of about 20 nucleotides in length. There is no need to say that the hybridization conditions described above are to be adapted according to the length of the desired nucleic acid, following techniques well known to the one skilled in the art. The suitable hybridization conditions may for example be adapted according to the teachings disclosed in the book of Hames and Higgins (*NucleicAcid Hybridization: A Practical Approach,* IRL Press, Oxford, 1985) or in Sambrook et al. (*Molecular Cloning: A Laboratory Manual,* $2^{nd}$ edition, Cold Spring Harbor Laboratory, Cold Spring Harbor, N.Y., 1989), the disclosures of which are incorporated herein by reference in their entireties.

I. Biallelic Markers and Polynucleotides Comprising Biallelic Markers

A. Polynucleotides of the Present Invention

The present invention encompasses polynucleotides for use as primers and probes in the methods of the invention.

These polynucleotides may consist of, consist essentially of, or comprise a contiguous span of nucleotides of a sequence from any sequence in the Sequence Listing as well as sequences which are complementary thereto ("complements thereof"). The "contiguous span" maybe at least 8, 10, 12, 15, 18, 20, 25, 35, 40, 50, 70, 80, 100, 250, 500 or 1000 nucleotides in length, to the extent that a contiguous span of these lengths is consistent with the lengths of the particular Sequence ID. It should be noted that the polynucleotides of the present invention are not limited to having the exact flanking sequences surrounding the polymorphic bases which, are enumerated in the Sequence Listing. Rather, it will be appreciated that the flanking sequences surrounding the biallelic markers, or any of the primers of probes of the invention which, are more distant from the markers, may be lengthened or shortened to any extent compatible with their intended use and the present invention specifically contemplates such sequences. It will be appreciated that the polynucleotides referred to in the Sequence Listing may be of any length compatible with their intended use. Also the flanking regions outside of the contiguous span need not be homologous to native flanking sequences which actually occur in human subjects. The addition of any nucleotide sequence, which is compatible with the nucleotides intended use is specifically contemplated. The contiguous span may optionally include the DME-related biallelic marker in said sequence. Biallelic markers generally consist of a polymorphism at one single base position. Each biallelic marker therefore corresponds to two forms of a polynucleotide sequence which, when compared with one another, present a nucleotide modification at one position. Usually, the nucleotide modification involves the substitution of one nucleotide for another. Optionally either the original or the alternative allele of the biallelic markers disclosed in Table 13, or the first or second allele disclosed in Table 12 and 13 may be specified as being present at the DME-related biallelic marker. Optionally, the biallelic markers may be specified as 12-421-135, 12-442-133, 12-449-63, 12-454-242, 12-463-230, 12-462-199, 10-430-287, 12-718-432, 12-269-301, 2-13-398, 2-28-132, 2-39-27, 245-155, 24-391, 12-345-410, 10-358-353, 10-360-190, 10-365-374, 10-367-58, 12-468-424, 12-481-293, 12-499-86, 12-500-217, 12-511-101, 12-586-443, 12-593-287, 12-795-383, 10-494-332, 12-659-251, 12-912-419, 12-914-28, 12-624-307 which consist of more complex polymorphisms including insertions/deletions of at least one nucleotide. Optionally either the original or the alternative allele of these biallelic markers may be specified as being present at the DME-related biallelic marker. Preferred polynucleotides may consist of, consist essentially of, or comprise a contiguous span of nucleotides of a sequence from SEQ ID No. 929–961 well as sequences which are complementary thereto. The "contiguous span" may be at least 8, 10, 12, 15, 18, 20, 25, 35, 40, 50, 70, 80, 100, 250, 500 or 1000 nucleotides in length, to the extent that a contiguous span of these lengths is consistent with the lengths of the particular Sequence ID. The contiguous span may optionally comprise a biallelic marker selected from the group consisting of biallelic markers 12-421-135, 12-442-133, 12-449-63, 12-454-242, 12-463-230, 12-462-199, 10-430-287, 12-718-432, 12-269-301, 2-13-398, 2-28-132, 2-39-27, 2-45-155, 2-4-391, 12-345-410, 10-358-353, 10-360-190, 10-365-374, 10-367-58, 12-468-424, 12-281-293, 12-499-86, 12-500-217, 12-511-101, 12-586-443, 12-593-287, 12-795-383, 10-494-332, 12-659-251, 12-912-419, 12-914-28, 12-624-307.

The preferred polynucleotides of the invention include the sequence ranges included in any one the sequence ranges of Tables 12, and 15 to 18 individually or in groups consisting of all the possible combinations of the ranges of included in Tables 12, and 15 to 18. The preferred polynucleotides of the invention also include fragments of at least 8, 10, 12, 15, 18, 20, 25, 35, 40, 50, 70, 80, 100, 250, 500 or 1000 consecutive nucleotides of the sequence ranges included in any one of the sequence ranges of Tables 12, and 15 to 18 to the extent that fragments of these lengths are consistent with the lengths of the particular sequence range. The preferred polynucleotides of the invention also include fragments of at least 8, 10, 12, 15, 18, 20, 25, 35, 40, 50, 70, 80, 100, 250, 500 or 1000 consecutive nucleotides of the sequence complementary to the sequence ranges included in any one of the sequence ranges of Tables 12, and 15 to 18 to the extent that fragments of these lengths are consistent with the lengths of the particular sequence range.

Preferred polynucleotides of the invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides of a sequence selected from the group consisting of the sequences of SEQ ID Nos. 485–487, 490–493, 495, 496, 498–523, 930–934, and 965, and the complements thereof.

Particularly preferred polynucleotides of the invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No. 485, wherein said contiguous span comprises at least 1, 2, 3, 4, 5 or 10 of the following nucleotide positions of SEQ ID No. 485: 1 to 7667, 7726 to 20264, 20365 to 36918, 36991 to 45180, 45263 to 45741, and 45980 to 49327, and the complements thereof. Other particularly preferred polynucleotides of the present invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No. 486, wherein said contiguous span comprises at least 1, 2, 3, 4, 5 or 10 of nucleotide positions 1 to 198 of SEQ ID No. 486 and the complements thereof. Other particularly preferred polynucleotides of the present invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No. 487, wherein said contiguous span comprises at least 1, 2, 3, 4, 5 or 10 of nucleotide positions 1 to 198 of SEQ ID No. 487 and the complements thereof. Other particularly preferred polynucleotides of the present invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No. 490, wherein said contiguous span comprises at least 1, 2, 3, 4, 5 or 10 of nucleotide positions 1 to 198 of SEQ ID No. 490 and the complements thereof. Other preferred polynucleotides of the present invention include polynucleotides comprising, consisting of, or consisting essentially of a nucleotide sequence of SEQ ID No. 491.

Particularly preferred polynucleotides of the present invention include purified, isolated or recombinant polynucleotides comprising a contiguous span of at least 12, 15, 18, 20, 25, 30, 35, 40, 50, 60, 70, 80, 90, 100, 150, 200, 500, or 1000 nucleotides of a sequence selected from the group consisting of SEQ ID SEQ ID Nos. 3, 5, 9, 13–15, 25, 31, 33, 37, 38, 41, 323, 345, 351–353, 357, 377, and 380, or the complements thereof; or more preferably SEQ ID Nos. 496, 498, 502, 506–508, 518, 524, 526, 530, 531, 534, 816, 838, 844–846, 850, 870, and 873, or the complements thereof, wherein said span includes a MGST-II-related biallelic marker. Optionally either allele of the biallelic markers described above in the definition of MGST-II-related biallelic marker is specified as being present at the MGST-II-related biallelic marker.

Additional preferred polynucleotides of the invention include isolated, purified or recombinant polynucleotide comprising a contiguous span of at least 12 nucleotides of SEQ ID No. 485 or the complementary sequence thereof, wherein said contiguous span comprises a nucleotide selected from the group consisting of a T at position 36971, a C at position 45214 or a T at position 45741 of SEQ ID No. 485. Additional preferred polynucleotides of the invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides from a sequence of SEQ ID No. 486, wherein said contiguous span comprises a T at position 426, a C at position 478 or a T at position 526 of SEQ ID No. 486; or the complement thereof. Additional preferred polynucleotides of the invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides from a sequence of SEQ ID No. 487, wherein said contiguous span comprises a T at position 325, a C at position 378 or a T at position 426 of SEQ ID No. 487; or the complements thereof.

Table 3(A–D) contains a list of preferred MGST-II-related biallelic markers. Each marker is described by indicating its Marker ID, the position of the marker in the SEQ ID and the two most common alleles.

TABLE 3A

NON-GENOMIC BIALLELIC MARKERS

| BIALLELIC MARKER ID | ALLELES | POSITION OF BIALLELIC MARKER IN SEQ ID (FIG. 1A) | | POSITION OF BIALLELIC MARKER IN SEQ ID (FIG. 1B) | |
|---|---|---|---|---|---|
| | | SEQ ID NO. | Position | SEQ ID No. | Position |
| 12-424-192 | A/G | 2 | 501 | 495 | 47 |
| 12-424-198 | G/T | 3 | 501 | 496 | 47 |
| 12-426-154 | G/A | 5 | 461 | 498 | 47 |
| 12-429-198 | C/T | 6 | 501 | 499 | 47 |
| 12-430-80 | C/T | 7 | 501 | 500 | 47 |
| 12-433-215 | A/G | 8 | 501 | 501 | 47 |
| 12-441-233 | A/G | 9 | 501 | 502 | 47 |
| 12-441-343 | G/A | 10 | 501 | 503 | 47 |
| 12-442-221 | T/C | 11 | 501 | 504 | 47 |
| 12-447-58 | G/C | 12 | 501 | 505 | 47 |
| 12-449-300 | T/C | 472 | 501 | 965 | 47 |
| 12-453-429 | C/T | 13 | 501 | 506 | 47 |
| 12-454-363 | A/G | 14 | 501 | 507 | 47 |
| 12-455-326 | T/C | 15 | 501 | 508 | 47 |
| 12-455-383 | G/A | 16 | 501 | 509 | 47 |
| 12-456-269 | A/G | 17 | 501 | 510 | 47 |
| 12-456-380 | G/T | 18 | 501 | 511 | 47 |
| 12-457-204 | A/G | 19 | 501 | 512 | 47 |
| 12-457-206 | C/T | 20 | 501 | 513 | 47 |
| 12-458-196 | A/T | 21 | 501 | 514 | 47 |
| 12-458-438 | T/C | 22 | 501 | 515 | 47 |
| 12-460-274 | A/G | 23 | 501 | 516 | 47 |
| 12-461-124 | A/C | 24 | 501 | 517 | 47 |
| 12-461-299 | C/T | 25 | 501 | 518 | 47 |
| 12-461-465 | C/T | 26 | 501 | 519 | 47 |
| 12-462-280 | C/T | 27 | 501 | 520 | 47 |
| 12-464-66 | G/T | 28 | 501 | 521 | 47 |
| 12-465-234 | G/T | 30 | 501 | 523 | 47 |
| 12-465-26 | C/T | 29 | 501 | 522 | 47 |
| 12-442-133 | Deletion G | 437 | 501 | 930 | 47 |
| 12-449-63 | Insertion AT | 438 | 501 | 931 | 47 |
| 10-454-242 | Deletion AT | 439 | 501 | 932 | 47 |
| 12-463-230 | Deletion CAT | 440 | 501 | 933 | 47 |
| 12-426-199 | Deletion | 441 | 501 | 934 | 47 |

TABLE 3B

BIALLELIC MARKERS IN GENOMIC SEQUENCE (SEQ ID No. 485)

| BIALLELIC MARKER ID | ALLELES | POSITION OF BIALLELIC MARKER IN SEQ ID |
|---|---|---|
| 10-286-289 | G/C | 7564 |
| 10-286-345 | A/T | 7619 |
| 10-286-375 | A/G | 7649 |
| 12-425-57 | G/A | 17258 |
| 12-421-135 | insertion of a T | 2590 |
| 12-421-140 | A/G | 21595 |
| 10-523-232 | C/T | 36971 |
| 10-289-201 | C/T | 45214 |
| 10-290-37 | C/T | 45741 |
| 10-290-326 | A/G | 46029 |
| 10-290-328 | G/T | 46032 |

TABLE 3C

BIALLELIC MARKERS IN MGST-II cDNA (SEQ ID No 486)

| BIALLELIC MARKER ID | ALLELES | POSITION OF BIALLELIC MARKER IN SEQ ID |
|---|---|---|
| 10-286-289 | G/C | 98 |
| 10-286-345 | A/T | 153 |
| 10-286-375 | A/G | 183 |
| 10-289-201 | C/T | 478 |
| 10-290-37 | C/T | 526 |

TABLE 3D

BIALLELIC MARKERS IN MGST-II cDNA (SEQ ID No 487)

| BIALLELIC MARKER ID | ALLELES | POSITION OF BIALLELIC MARKER IN SEQ ID |
|---|---|---|
| 10-286-289 | G/C | 98 |
| 10-286-345 | A/T | 153 |
| 10-286-375 | A/G | 183 |
| 10-289-201 | C/T | 378 |
| 10-290-37 | C/T | 426 |

The invention also relates to polynucleotides that hybridize, under conditions of high or intermediate stringency, to a polynucleotide of a sequence from any sequence in the Sequence Listing as well as sequences, which are complementary thereto. Preferably such polynucleotides are at least 20, 25, 35, 40, 50, 70, 80, 100, 250, 500 or 1000 nucleotides in length, to the extent that a polynucleotide of these lengths is consistent with the lengths of the particular Sequence ID. Preferred polynucleotides comprise a DME-related biallelic marker. Optionally either the original or the alternative allele of the biallelic markers disclosed in Table 13 may be specified as being present at the DME-related biallelic marker. Conditions of high and intermediate stringency are further described in "Methods of Genotyping DNA Samples for Biallelic Markers-Hybridization Assay Methods."

The present invention further embodies isolated, purified, and recombinant polynucleotides which encode MGST-II polypeptides comprising a contiguous span of at least 6 amino acids, preferably at least 8 to 10 amino acids, more preferably at least 12, 15, 20, 25, 30, 40, 50, or 100 amino acids of SEQ ID No. 488. The present invention further embodies isolated, purified, and recombinant polynucleotides which encode the variant MGST-II polypeptides of SEQ ID Nos. 488 and 489. The present invention further embodies isolated, purified, and recombinant polynucleotides which encode a variant MGST-II polypeptide comprising a contiguous span of at least 6 amino acids, preferably at least 8 to 10 amino acids, more preferably at least 12, 15, 20, 25, 30, 40, 50, or 100 amino acids of SEQ ID No. 489. The present invention further embodies isolated, purified, and recombinant polynucleotides which encode polypeptides comprising a contiguous span of at least 6 amino acids, preferably at least 8 to 10 amino acids, more preferably at least 12, 15, 20, 25, 30, 40, 50, or 100 amino acids of SEQ ID No. 488 wherein said contiguous span comprises a His residue at amino acid position 93. The present invention further embodies isolated, purified, and recombinant polynucleotides which encode polypeptides comprising a contiguous span of at least 6 amino acids, preferably at least 8 to 10 amino acids, more preferably at least 12, 15, 20, 25, 30, 40, 50, or 100 amino acids of amino acid positions 1–108 of SEQ ID No. 488.

The primers of the present invention may be designed from the disclosed sequences for any method known in the art. A preferred set of primers is fashioned such that the 3' end of the contiguous span of identity with the sequences of the Sequence Listing is present at the 3' end of the primer. Such a configuration allows the 3' end of the primer to hybridize to a selected nucleic acid sequence and dramatically increases the efficiency of the primer for amplification or sequencing reactions. In a preferred set of primers the contiguous span is found in one of the sequences described in Table 15. Allele specific primers may be designed such that a biallelic marker is at the 3' end of the contiguous span and the contiguous span is present at the 3' end of the primer. Such allele specific primers tend to selectively prime an amplification or sequencing reaction so long as they are used with a nucleic acid sample that contains one of the two alleles present at a biallelic marker. The 3' end of primer of the invention may be located within or at least 2, 4, 6, 8, 10, 12, 15, 18, 20, 25, 50, 100, 250, 500, or 1000, to the extent that this distance is consistent with the particular Sequence ID, nucleotides upstream of a DME-related biallelic marker in said sequence or at any other location which is appropriate for their intended use in sequencing, amplification or the location of novel sequences or markers. A list of preferred amplification primers is disclosed in Table 17. Primers with their 3' ends located 1 nucleotide upstream of a DME-related biallelic marker have a special utility as microsequencing assays. Preferred microsequencing primers are described in Table 16.

The probes of the present invention may be designed from the disclosed sequences for any method known in the art, particularly methods which allow for testing if a particular sequence or marker disclosed herein is present. A preferred set of probes may be designed for use in the hybridization assays of the invention in any manner known in the art such that they selectively bind to one allele of a biallelic marker, but not the other under any particular set of assay conditions. Preferred hybridization probes may consists of, consist essentially of, or comprise a contiguous span which ranges in length from 8, 10, 12, 15, 18 or 20 to 25, 35, 40, 50, 60, 70, or 80 nucleotides, or be specified as being 12, 15, 18, 20, 25, 35, 40, or 50 nucleotides in length and including a DME-related biallelic marker of said sequence. Optionally the original allele or alternative allele disclosed in Table 13 and 14 may be specified as being present at the biallelic marker site. Optionally, said biallelic marker may be within 6, 5, 4, 3, 2, or 1 nucleotides of the center of the hybridization probe or at the center of said probe. A particularly preferred set of hybridization probes is disclosed in Table 18 or a sequence complementary thereto.

Any of the polynucleotides of the present invention can be labeled, if desired, by incorporating a label detectable by spectroscopic, photochemical, biochemical, immunochemical, or chemical means. For example, useful labels include radioactive substances, fluorescent dyes or biotin. Preferably, polynucleotides are labeled at their 3' and 5' ends. A label can also be used to capture the primer, so as to facilitate the immobilization of either the primer or a primer extension product, such as amplified DNA, on a solid support. A capture label is attached to the primers or probes and can be a specific binding member which forms a binding pair with the solid's phase reagent's specific binding member (e.g. biotin and streptavidin). Therefore depending upon the type of label carried by a polynucleotide or a probe, it may be employed to capture or to detect the target DNA. Further, it will be understood that the polynucleotides, primers or probes provided herein, may, themselves, serve as the capture label. For example, in the case where a solid phase reagent's binding member is a nucleic acid sequence, it may be selected such that it binds a complementary portion of a primer or probe to thereby immobilize the primer or probe to the solid phase. In cases where a polynucleotide probe itself serves as the binding member, those skilled in the art will recognize that the probe will contain a sequence or "tail" that is not complementary to the target. In the case where a polynucleotide primer itself serves as the capture label, at least a portion of the primer will be free to hybridize with a nucleic acid on a solid phase. DNA Labeling techniques are well known to the skilled technician.

Any of the polynucleotides, primers and probes of the present invention can be conveniently immobilized on a solid support. Solid supports are known to those skilled in the art and include the walls of wells of a reaction tray, test tubes, polystyrene beads, magnetic beads, nitrocellulose strips, membranes, microparticles such as latex particles, sheep (or other animal) red blood cells, duracytes® and others. The solid support is not critical and can be selected by one skilled in the art. Thus, latex particles, microparticles, magnetic or non-magnetic beads, membranes, plastic tubes, walls of microtiter wells, glass or silicon chips, sheep (or other suitable animal's) red blood cells and duracytes are all suitable examples. Suitable methods for immobilizing nucleic acids on solid phases include ionic, hydrophobic, covalent interactions and the like. A solid support, as used herein, refers to any material which is insoluble, or can be made insoluble by a subsequent reaction. The solid support can be chosen for its intrinsic ability to attract and immobilize the capture reagent. Alternatively, the solid phase can retain an additional receptor which has the ability to attract and immobilize the capture reagent. The additional receptor can include a charged substance that is oppositely charged with respect to the capture reagent itself or to a charged substance conjugated to the capture reagent. As yet another alternative, the receptor molecule can be any specific binding member which is immobilized upon (attached to) the solid support and which has the ability to immobilize the capture reagent through a specific binding reaction. The receptor molecule enables the indirect binding of the capture reagent to a solid support material before the performance of the assay or during the performance of the assay. The solid phase thus can be a plastic, derivatized plastic, magnetic or non-magnetic metal, glass or silicon surface of a test tube, microtiter well, sheet, bead, microparticle, chip, sheep (or other suitable animal's) red blood cells, duracytes® and other configurations known to those of ordinary skill in the art. The polynucleotides of the invention can be attached to or immobilized on a solid support individually or in groups of at least 2, 5, 8, 10, 12, 15, 20, or 25 distinct polynucleotides of the inventions to a single solid support. In addition, polynucleotides other than those of the invention may attached to the same solid support as one or more polynucleotides of the invention.

Any polynucleotide provided herein may be attached in overlapping areas or at random locations on the solid support. Alternatively the polynucleotides of the invention may be attached in an ordered array wherein each polynucleotide is attached to a distinct region of the solid support which does not overlap with the attachment site of any other polynucleotide. Preferably, such an ordered array of polynucleotides is designed to be "addressable" where the distinct locations are recorded and can be accessed as part of an assay procedure. Addressable polynucleotide arrays typically comprise a plurality of different oligonucleotide probes that are coupled to a surface of a substrate in different known locations. The knowledge of the precise location of each polynucleotides location makes these "addressable" arrays particularly useful in hybridization assays. Any addressable array technology known in the aft can be employed with the polynucleotides of the invention. One particular embodiment of these polynucleotide arrays is known as the Genechips™, and has been generally described in U.S. Pat. No. 5,143,854; PCT publications WO 90/15070 and 92/10092, the disclosures of which are incorporated herein by reference in their entirety. These arrays may generally be produced using mechanical synthesis methods or light directed synthesis methods, which incorporate a combination of photolithographic methods and solid phase oligonucleotide synthesis (Fodor et al., Science, 251:767–777, 1991). The immobilization of arrays of oligonucleotides on solid supports has been rendered possible by the development of a technology generally identified as "Very Large Scale Immobilized Polymer Synthesis" (VLSIPS™) in which, typically, probes are immobilized in a high density array on a solid surface of a chip. Examples of VLSIPS™ technologies are provided in U.S. Pat. Nos. 5,143,854 and 5,412,087 and in PCT Publications WO 90/15070, WO 92/10092 and WO 95/11995, the disclosures of which are incorporated herein by reference in their entirety, which describe methods for forming oligonucleotide arrays through techniques such as light-directed synthesis techniques. In designing strategies aimed at providing arrays of nucleotides immobilized on solid supports, further presentation strategies were developed to order and display the oligonucleotide arrays on the chips in an attempt to maximize hybridization patterns and sequence information. Examples of such presentation strategies are disclosed in PCT Publications WO 94/12305, WO 94/11530, WO 97/29212 and WO 97/31256, the disclosures of which are incorporated herein by reference in their entirety.

Oligonucleotide arrays may comprise at least one of the sequences selected from the group consisting of SEQ ID Nos. 1–38, 40–54, 56–353, 355–463, and 465–487, and the sequences complementary thereto; or more preferably SEQ ID Nos. 485–487, 494–531, 533–547, 549–846, 848–956, and 958–977, and the sequences complementary thereto; or a fragment thereof of at least 8, 10, 12, 15, 18, 20, 25, 35, 40, 50, 70, 80, 100, 250, 500 or 1000 consecutive nucleotides, to the extent that fragments of these lengths is consistent with the lengths of the particular Sequence ID, for determining whether a sample contains one or more alleles of the biallelic markers of the present invention. Oligonucleotide arrays may also comprise at least one of the sequences selected from the group consisting of SEQ ID Nos. 1–38, 40–54, 56–353, 355–463, and 465–487, and the sequences complementary thereto; or more preferably SEQ ID Nos. 485–487, 494–531, 533–547, 549–846, 848–956, and 958–977, and the sequences complementary thereto; or a fragment thereof of at least 8, 10, 12, 15, 18, 20, 25, 35, 40, 50, 70, 80, 100, 250, 500 or 1000 consecutive nucleotides, to the extent that fragments of these lengths is consistent with the lengths of the particular Sequence ID, for amplifying one or more alleles of the biallelic markers of Table 11. In other embodiments, arrays may also comprise at least one of the sequences selected from the group consisting of SEQ ID Nos. 1–38, 40–54, 56–353, 355–463, and 465–487, and the sequences complementary thereto; or more preferably SEQ ID Nos. 485–487, 494–531, 533–547, 549–846, 848–956, and 958–977, and the sequences complementary thereto; or a fragment thereof of at least 8, 10, 12, 15, 18, 20, 25, 35, 40, 50, 70, 80, 100, 250, 500 or 1000 consecutive nucleotides, to the extent that fragments of these lengths is consistent with the lengths of the particular Sequence ID, for conducting microsequencing analyses to determine whether a sample contains one or more alleles of the biallelic markers of the invention. In still further embodiments, the oligonucleotide array may comprise at least one of the sequences selecting from the group consisting of SEQ ID Nos. 1–38, 40–54, 56–353, 355–463, and 465–487, and the sequences complementary thereto; or more preferably SEQ ID Nos. 485–487, 494–531, 533–547, 549–846, 848–956, and 958–977, and the sequences complementary thereto; or a fragment thereof of at least 8, 10, 12, 15, 18, 20, 25, 35, 40, 50, 70, 80, 100, 250, 500 or 1000 nucleotides in length, to the extent that fragments of these lengths is consistent with the lengths of the particular Sequence ID, for determining whether a sample contains one or more alleles of the biallelic markers of the present invention.

The present invention also encompasses diagnostic kits comprising one or more polynucleotides of the invention, optionally with a portion or all of the necessary reagents and instructions for genotyping a test subject by determining the identity of a nucleotide at a DME-related biallelic marker. The polynucleotides of a kit may optionally be attached to a solid support, or be part of an array or addressable array of polynucleotides. The kit may provide for the determination of the identity of the nucleotide at a marker position by any method known in the art including, but not limited to, a sequencing assay method, a microsequencing assay method, a hybridization assay method, or an allele specific amplification method. Optionally such a kit may include instructions for scoring the results of the determination with respect to the test subjects' risk of contracting a diseases involving the metabolic conversion of xenobiotics, or likely response to a drug, or chances of suffering from side effects to a drug, including hepatotoxicity.

B. Genomic Sequences of the MGST-II Gene and Biallelic Markers

The present invention encompasses the genomic sequence of the MGST-II gene of SEQ ID No. 485. The MGST-II genomic sequences comprise exons and introns. Particularly preferred genomic sequences of the MGST-II gene of the invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No. 485, wherein said contiguous span comprises at least 1, 2, 3, 4, 5 or 10 of the following nucleotide positions of SEQ ID No. 485: 1 to 7667, 7726 to 20264, 20365 to 36918, 36991 to 45180, 45263 to 45741, and 45980 to 49327, and the complements thereof. The nucleic acids defining the MGST-II intronic polynucleotides may be used as oligonucleotide primers or probes in order to detect the presence of a copy of the MGST-II gene in a test sample, or alternatively in order to amplify a target nucleotide sequence within the MGST-II sequences.

The present invention further provides MGST-II intron and exon polynucleotide sequences including biallelic markers. Particularly preferred polynucleotides of the present invention include purified, isolated or recombinant polynucleotides comprising a contiguous span of at least 12, 15, 18, 20, 25, 30, 35, 40, 50, 60, 70, 80, 90, 100, 150, 200, 500, or 1000 nucleotides of a sequence of SEQ ID No. 485; or the complements thereof; wherein said span includes a MGST-II-related biallelic marker. Preferred polynucleotides comprise at least one biallelic marker selected from the group consisting of biallelic markers 10-286-289, 10-287-116, 10-286-375, 12-425-57, 12-421-135, 12-421-140, 10-523-232, 10-289-201, 10-290-37, 10-290-326 and 10-290-328. The present invention also provides polynucleotides which, may be used as primers and probes in order to amplify fragments carrying biallelic markers or in order to detect biallelic marker alleles.

Regulatory Sequences

The genomic sequence of the MGST-II gene contains regulatory sequences both in the non-coding 5'-flanking region and in the non-coding 3'-flanking region that border the MGST-II transcribed region containing the 5 exons of this gene. 5'-regulatory sequences of the MGST-II gene comprise the polynucleotide sequences located between the nucleotide in position 1 and the nucleotide in position 7466 of the nucleotide sequence of SEQ ID No. 485. 3'-regulatory sequences of the MGST-II gene comprise the polynucleotide sequences located between the nucleotide in position 45980 and the nucleotide in position 49327 of the nucleotide sequence of SEQ II) No. 485. Particularly preferred regulatory polynucleotides of the present invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No. 485, wherein said contiguous span comprises at least 1, 2, 3, 4, 5 or 10 of the following nucleotide positions of SEQ ID No. 485: 1 to 7466 and 45966 to 49312; and the complements thereof.

The promoter activity of the regulatory regions contained in the MGST-II genomic sequence of polynucleotide sequence of SEQ ID No. 485 can be assessed by any method known in the art. Methods for identifying the polynucleotide fragments of SEQ ID No. 485 involved in the regulation of the expression of the MGST-II gene are well-known to those skilled in the art (see Sambrook et al., Molecular Cloning A Laboratory Manual, Cold Spring Harbor Laboratory, Cold Spring Harbor, N.Y., 1989). An example of a typical method, that can be used, involves a recombinant vector carrying a reporter gene and genomic sequences from the MGST-II genomic sequence of SEQ ID No. 485. Briefly, the expression of the reporter gene (for example beta galactosidase or chloramphenicol acetyl transferase) is detected when placed under the control of a biologically active polynucleotide fragment. Genomic sequences located upstream of the first exon of the MGST-II gene may be cloned into any suitable promoter reporter vector, such as the pSEAP-Basic, pSEAP-Enhancer, pβgal-Basic, pβgal-Enhancer, or pEGFP-1 Promoter Reporter vectors available from Clontech, or pGL2-basic or pGL3-basic promoterless luciferase reporter gene vector from Promega. Each of these promoter reporter vectors include multiple cloning sites positioned upstream of a reporter gene encoding a readily assayable protein such as secreted alkaline phosphatase, luciferase, beta galactosidase, or green fluorescent protein. The sequences upstream the first MGST-II exon are inserted into the cloning sites upstream of the reporter gene in both orientations and introduced into an appropriate host cell. The level of reporter protein is assayed and compared to the level obtained with a vector lacking an insert in the cloning site. The presence of an elevated expression level in the vector containing the insert with respect to the control vector indicates the presence of a promoter in the insert.

Promoter sequences within the 5' non-coding regions of the MGST-II gene may be further defined by constructing nested 5' and/or 3' deletions using conventional techniques such as Exonuclease III or appropriate restriction endonuclease digestion. The resulting deletion fragments can be inserted into the promoter reporter vector to determine whether the deletion has reduced or obliterated promoter activity, such as described, for example, by Coles et al. (*Hum. Mol. Genet.*, 7:791–800, 1998). In this way, the boundaries of the promoters may be defined. If desired, potential individual regulatory sites within the promoter may be identified using site directed mutagenesis or linker scanning to obliterate potential transcription factor binding sites within the promoter individually or in combination. The effects of these mutations on transcription levels may be determined by inserting the mutations into cloning sites in promoter reporter vectors. This type of assays are well known to those skilled in the art and are further described in WO 97/17359, U.S. Pat. No. 5,374,544, EP 582 796, U.S. Pat. Nos. 5,698,389, 5,643,746, 5,502,176, and 5,266,488.

The activity and the specificity of the promoter of the MGST-II gene can further be assessed by monitoring the expression level of a detectable polynucleotide operably linked to the MGST-II promoter in different types of cells and tissues. The detectable polynucleotide may be either a polynucleotide that specifically hybridizes with a predefined oligonucleotide probe, or a polynucleotide encoding a detectable protein, including a MGST-II polypeptide or a fragment or a variant thereof. This type of assay is well known to those skilled in the art and is described in U.S. Pat. Nos. 5,502,176 and 5,266,488 for example.

Polynucleotides carrying the regulatory elements located both at the 5' end and at the 3' end of the MGST-II coding region may be advantageously used to control the transcriptional and translational activity of an heterologous polynucleotide of interest, said polynucleotide being heterologous as regards to the MGST-II regulatory region.

Thus, the present invention also concerns a purified, isolated, and recombinant nucleic acid comprising a polynucleotide which, is selected from the group consisting of, the polynucleotide sequences located between the nucleotide in position 1 and the nucleotide in position 7466 of the nucleotide sequence of SEQ ID No. 485; or a sequence complementary thereto or a biologically active fragment thereof.

By a "biologically active" fragment of SEQ ID No. 485 according to the present invention is intended a polynucleotide comprising or alternatively consisting of a fragment of said polynucleotide which is functional as a regulatory region for expressing a recombinant polypeptide or a recombinant polynucleotide in a recombinant cell host.

For the purpose of the invention, a nucleic acid or polynucleotide is "functional" as a regulatory region for expressing a recombinant polypeptide or a recombinant polynucleotide if said regulatory polynucleotide contains nucleotide sequences which contain transcriptional and translational regulatory information, and such sequences are "operably linked" to nucleotide sequences which encode the desired polypeptide or the desired polynucleotide.

The regulatory polynucleotides according to the invention may be advantageously part of a recombinant expression vector that may be used to express a coding sequence in a desired host cell or host organism.

C. MGST-II cDNA Comprising Biallelic Markers and Variant MGST-II cDNA

The present invention provides a MGST-II cDNA of SEQ ID No. 486. The Open Reading Frame encoding the MGST-II protein spans from the nucleotide in position 202 to the nucleotide in position 642 of the polynucleotide sequence of SEQ ID No. 486. The cDNA of SEQ ID No. 486 also includes a 5'-UTR region and a 3'-UTR region.

Particularly preferred cDNA polynucleotides of the present invention include purified, isolated or recombinant polynucleotides comprising a contiguous span of at least 12, 15, 18, 20, 25, 30, 35, 40, 50, 60, 70, 80, 90, 100, 150, 200, 500, or 1000 nucleotides of a sequence of SEQ ID No. 486, or the complements thereof, wherein said span includes a MGST-II-related biallelic marker. Preferred cDNA fragments comprise a biallelic marker selected from the group consisting of 10-286-289 (position 98), 10-286-345 (position 153), 10-286-375 (position 183), 10-523-232 (position 426), 10-289-201 (position 478) and 10-290-37 (position 526). Additional preferred polynucleotides of the invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides from a sequence of SEQ ID No. 486, wherein said contiguous span comprises a T at position 426, a C at position 478 or a T at position 526 of SEQ ID No. 486; or the complement thereof. Most biallelic polymorphisms represent silent nucleotide substitutions but biallelic marker 10-289-201 is associated with an amino acid change in the corresponding MGST-II polypeptide (TYR replaced by ARG in position 93 of the polypeptide). Moreover, one biallelic marker allele of marker 10-290-37 is associated with a stop codon and the corresponding variant cDNA encodes a truncated MGST-II polypeptide including amino acids 1 to 108.

The present invention further provides a variant MGST-II cDNA of SEQ ID No. 487. corresponding to an alternative splicing form which results in the deletion of exon 2. This alternative splicing of MGST-II yields the variant MGST-II polypeptide of SEQ ID No. 489. MGST-II polypeptides of the present invention are further described below. Preferred cDNAs of the invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides from a sequence of SEQ ID No. 487; or the complements thereof. Additional preferred polynucleotides of the invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides from a sequence of SEQ ID No. 487, wherein said contiguous span comprises a T at position 325, a C at position 378 or a T at position 426 of SEQ ID No. 487; or the complements thereof. The new exon 1/exon 3 junction sequence of the splice variant MGST-II cDNA, more particularly the nucleotide sequence comprised between the nucleotide in position 106 and the nucleotide in position 374 of the nucleic acid of SEQ ID No. 486 corresponds to the nucleotide sequence of an EST that has been obtained from a human cDNA library. Polynucleotides comprising this EST of a sequence from SEQ ID No. 490 are also part of the invention.

The above disclosed polynucleotides that contain the coding sequence of the MGST-II gene and of MGST-II variants may be expressed in a desired host cell or a desired host organism, when this polynucleotide is placed under the control of suitable expression signals. The expression signals may be either the expression signals contained in the regulatory regions in the MGST-II gene of the invention or in contrast the signals may be exogenous regulatory nucleic sequences. Such a polynucleotide, when placed under the suitable expression signals, may also be inserted in a vector for its expression and/or amplification.

Another preferred cDNA fragment comprises the 5'-UTR region (regulatory) beginning at position 1 and ending at position 201 of SEQ ID Nos. 486 and 487. Preferably said 5'-UTR region comprises a biallelic marker selected from the group consisting of biallelic markers 10-286-289, 10-286-345 and 10-286-375. Particularly preferred 5'-UTR polynucleotides of the present invention include isolated, purified or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No. 486, wherein said contiguous span comprises at least 1, 2, 3, 4, 5 or 10 of nucleotide positions 1 to 198 of SEQ ID No. 486; and the complements thereof. The 5'-end sequence of the MGST-II cDNA, more particularly the nucleotide sequence comprised between the nucleotide in position 1 and the nucleotide in position 357 of the nucleic acid of SEQ ID No. 486 corresponds to the nucleotide sequence of a 5'-EST that has been obtained from a human cDNA library. Polynucleotides comprising this 5'-EST of a sequence from SEQ ID No. 490 are also part of the invention.

The polynucleotide disclosed above that contains the coding sequence of the MGST-II gene of the invention may be expressed in a desired host cell or a desired host organism, when this polynucleotide is placed under the control of suitable expression signals. The expression signals may be either the expression signals contained in the regulatory regions in the MGST-II gene of the invention or may be exogenous regulatory nucleic sequences. Such a polynucleotide, when placed under the suitable expression signals, may also be inserted in a vector for its expression.

A further object of the invention consists of an isolated polynucleotide comprising:

a) a nucleic acid comprising a regulatory nucleotide sequence from a sequence of SEQ ID No. 485;

b) a polynucleotide encoding a desired polypeptide or a nucleic acid of interest, operably linked to the nucleic acid defined in (a) above; and c) Optionally, a nucleic acid comprising a 5'-UTR regulatory polynucleotide, preferably a 5'-UTR regulatory polynucleotide sequence of a sequence of SEQ ID No. 486.

The polypeptide encoded by the nucleic acid described above may be of various nature or origin, encompassing proteins of prokaryotic or eukaryotic origin. Among the polypeptides expressed under the control of a MGST-II regulatory region, there may be cited bacterial, fungal or viral antigens. Also encompassed are eukaryotic proteins such as intracellular proteins, for example "house keeping" proteins, membrane-bound proteins, for example receptors, and secreted proteins, for example cytokines. In a specific embodiment, the desired polypeptide may be the MGST-II protein, especially the proteins of the amino acid sequence of SEQ ID Nos. 488 and 489.

The desired nucleic acids encoded by the above described polynucleotide, usually a RNA molecule, may be complementary to a desired coding polynucleotide, for example to the MGST-II coding sequence, and thus useful as an antisense polynucleotide.

Such a polynucleotide may be included in a recombinant expression vector in order to express the desired polypeptide or the desired nucleic acid in host cell or in a host organism.

D. Polynucleotide Constructs, Recombinant Vectors, Host Cells and Transgenic Animals Polynucleotide Constructs The terms "polynucleotide construct" and "recombinant polynucleotide" are used interchangeably herein to refer to linear or circular, purified or isolated polynucleotides that have been artificially designed and which comprise at least two nucleotide sequences that are not found as contiguous nucleotide sequences in their initial natural environment.

1. DNA Constructs for Expressing the MGST-II Gene in Recombinant Host Cells and in Transgenic Animals In order to study the physiological and phenotype consequences of a lack of synthesis of the MGST-II protein, both at the cellular level and at the multicellular organism level, in particular as regards to disorders related to abnormal cell proliferation, notably cancers, the invention also encompasses DNA constructs and recombinant vectors enabling a conditional expression of a specific allele of the MGST-II genomic sequence or cDNA.

A first preferred DNA construct is based on the tetracycline resistance operon tet from *E. coli* transposon Tn110 for controlling the MGST-II gene expression, such as described by Gossen et al. (*Science*, 268:1766–1769, 1995). Such a DNA construct contains seven tet operator sequences from Tn10 (tetop) that are fused to either a minimal promoter or a 5'-regulatory sequence of the MGST-II gene, said minimal promoter or said MGST-II regulatory sequence being operably linked to a polynucleotide of interest that codes either for a sense or an antisense oligonucleotide or for a polypeptide, including a MGST-II polypeptide or a peptide fragment thereof. This DNA construct is functional as a conditional expression system for the nucleotide sequence of interest when the same cell also comprises a nucleotide sequence coding for either the wild type (tTA) or the mutant (rTA) repressor fused to the activating domain of viral protein VP16 of herpes simplex virus, placed under the control of a promoter, such as the HCMVIE1 enhancer/promoter or the MMTV-LTR. Indeed, a preferred DNA construct of the invention will comprise both the polynucleotide containing the tet operator sequences and the polynucleotide containing a sequence coding for the tTA or the rTA repressor. In the specific embodiment wherein the conditional expression DNA construct contains the sequence encoding the mutant tetracycline repressor rTA, the expression of the polynucleotide of interest is silent in the absence of tetracycline and induced in its presence.

2. DNA Constructs Allowing Homologous Recombination: Replacement Vectors

A second preferred DNA construct will comprise, from 5'-end to 3'-end: (a) a first nucleotide sequence that is comprised in the MGST-II genomic sequence; (b) a nucleotide sequence comprising a positive selection marker, such as the marker for neomycine resistance (neo); and (c) a second nucleotide sequence that is comprised in the MGST-II genomic sequence, and is located on the genome downstream the first MGST-II nucleotide sequence (a).

In a preferred embodiment, this DNA construct also comprises a negative selection marker located upstream the nucleotide sequence (a) or downstream the nucleotide sequence (c). Preferably, the negative selection marker consists of the thymidine kinase (tk) gene (Thomas et al., *Cell*, 44:419–428, 1986), the hygromycine beta gene (Te Riele et al., *Nature*, 348:649–651, 1990), the hprt gene (Van der Lugt et al., *Gene*, 105:263–267, 1991; Reid et al., *Proc. Natl. Acad. Sci. USA*, 87:4299–4303, 1990) or the Diphteria toxin A fragment (Dt-A) gene (Nada et al., *Cell*, 73:1125–1135, 1993; Yagi et al., *Proc. Natl; Acad. Sci. USA*, 87:9918–9922, 1990). Preferably, the positive selection marker is located within a MGST-II exon sequence so as to interrupt the sequence encoding a MGST-II protein. These replacement vectors are further described by Mansour et al. (*Nature*, 336:348–352, 1988) and Koller et al. (*Ann. Rev. Immunol.*, 10:705–730, 1992). The first and second nucleotide sequences (a) and (c) may be indifferently located within a MGST-II regulatory sequence, an intronic sequence, an exon sequence or a sequence containing both regulatory and/or intronic and/or exon sequences. The size of the nucleotide sequences (a) and (c) is ranging from 1 to 50 kb, preferably from 1 to 10 kb, more preferably from 2 to 6 kb and most preferably from 2 to 4 kb.

3. DNA Constructs Allowing Homologous Recombination: Cre-loxP System

These new DNA constructs make use of the site specific recombination system of the P1 phage. The P1 phage possesses a recombinase called Cre which, interacts specifically with a 34 base pairs loxP site. The loxP site is composed of two palindromic sequences of 13 bp separated by a 8 bp conserved sequence (Hoess et al., *Nucleic Acids Res.*, 14:2287–2300, 1986). The recombination by the Cre enzyme between two loxP sites having an identical orientation leads to the deletion of the DNA fragment.

The Cre-loxP system used in combination with a homologous recombination technique has been first described by Gu et al. (*Cell*, 73:1155–1164, 1993). Briefly, a nucleotide sequence of interest to be inserted in a targeted location of the genome harbors at least two loxP sites in the same orientation and located at the respective ends of a nucleotide sequence to be excised from the recombinant genome. The excision event requires the presence of the recombinase (Cre) enzyme within the nucleus of the recombinant cell host. The recombinase enzyme may be brought at the desired time either by (a) incubating the recombinant cell hosts in a culture medium containing this enzyme, by injecting the Cre enzyme directly into the desired cell, such as described by Araki et al. (*Proc. Natl; Acad. Sci. USA*, 92: 160–164, 1995), or by lipofection of the enzyme into the cells, such as described by Baubonis et al. (*Nucleic Acids Res.*, 21:2025–2029, 1993); (b) transfecting the cell host with a vector comprising the Cre coding sequence operably linked to a promoter functional in the recombinant cell host, which promoter being optionally inducible, said vector being introduced in the recombinant cell host, such as described by Gu et al. (*Cell*, 73:1155–1164, 1993) and Sauer et al. (*Proc. Natl; Acad. Sci. USA*, 85:5166–5170, 1988); (c) introducing in the genome of the cell host a polynucleotide comprising the Cre coding sequence operably linked to a promoter functional in the recombinant cell host, which promoter is optionally inducible, and said polynucleotide being inserted in the genome of the cell host either by a random insertion event or an homologous recombination event, such as described by Gu et al. (*Science*, 265:103–106, 1994).

In the specific embodiment wherein the vector containing the sequence to be inserted in the MGST-II gene by homologous recombination is constructed in such a way that selectable markers are flanked by loxP sites of the same orientation, it is possible, by treatment by the Cre enzyme, to eliminate the selectable markers while leaving the MGST-II sequences of interest that have been inserted by an homologous recombination event. Again, two selectable markers are needed: a positive selection marker to select for the recombination event and a negative selection marker to select for the homologous recombination event. Vectors and methods using the Cre-loxP system are further described by Zou et al. (*Curr. Biol.*, 4:1099–1103, 1994).

Thus, a third preferred DNA construct of the invention comprises, from 5'-end to 3'-end: (a) a first nucleotide sequence that is comprised in the MGST-II genomic sequence; (b) a nucleotide sequence comprising a polynucleotide encoding a positive selection marker, said nucleotide sequence comprising additionally two sequences defining a site recognized by a recombinase, such as a loxP site, the two sites being placed in the same orientation; and (c) a second nucleotide sequence that is comprised in the MGST-II genomic sequence, and is located on the genome downstream of the first MGST-II nucleotide sequence (a).

The sequences defining a site recognized by a recombinase, such as a loxP site, are preferably located within the nucleotide sequence (b) at suitable locations bordering the nucleotide sequence for which the conditional excision is sought. In one specific embodiment, two loxP sites are located at each side of the positive selection marker sequence, in order to allow its excision at a desired time after the occurrence of the homologous recombination event.

In a preferred embodiment of a method using the third DNA construct described above, the excision of the polynucleotide fragment bordered by the two sites recognized by a recombinase, preferably two loxP sites, is performed at a desired time, due to the presence within the genome of the recombinant cell host of a sequence encoding the Cre enzyme operably linked to a promoter sequence, preferably an inducible promoter, more preferably a tissue-specific promoter sequence and most preferably a promoter sequence which is both inducible and tissue-specific, such as described by Gu et al. (*Science*, 265:103–106, 1994).

The presence of the Cre enzyme within the genome of the recombinant cell host may result of the breeding of two transgenic animals, the first transgenic animal bearing the MGST-II-derived sequence of interest containing the loxP sites as described above and the second transgenic animal bearing the Cre coding sequence operably linked to a suitable promoter sequence, such as described by Gu et al. (*Science*, 265:103–106, 1994).

Spatio-temporal control of the Cre enzyme expression may also be achieved with an adenovirus based vector that contains the Cre gene thus allowing infection of cells, or in vivo infection of organs, for delivery of the Cre enzyme, such as described by Anton et al. (*J. Virol.*, 69:4600–4606, 1995) and Kanegae et al. (*Nucleic Acids Res.*, 23:3816–3821, 1995).

The DNA constructs described above may be used to introduce a desired nucleotide sequence of the invention, preferably a MGST-II genomic sequence or a MGST-II cDNA sequence, and most preferably an altered copy of a MGST-II genomic or cDNA sequence, within a predetermined location of the targeted genome, leading either to the generation of an altered copy of a targeted gene (knock-out homologous recombination) or to the replacement of a copy of the targeted gene by another copy sufficiently homologous to allow an homologous recombination event to occur (knock-in homologous recombination).

Recombinant Vectors

The term "vector" is used herein to designate either a circular or a linear DNA or RNA molecule, which is either double-stranded or single-stranded, and which comprise at least one polynucleotide of interest that is sought to be transferred in a cell host or in a unicellular or multicellular host organism.

The present invention encompasses a family of recombinant vectors that comprise a regulatory polynucleotide derived from the MGST-II genomic sequence, or a coding polynucleotide from the MGST-II genomic sequence. Consequently, the present invention further deals with a recombinant vector comprising either a regulatory polynucleotide comprised in the nucleic acid of SEQ ID Nos. 485 and 486 or a polynucleotide comprising the MGST-II coding sequence or both.

In a first preferred embodiment, a recombinant vector of the invention is used to amplify the inserted polynucleotide derived from a MGST-II genomic sequence selected from the group consisting of the nucleic acids of SEQ ID No. 485 or a MGST-II cDNA, for example the cDNA of SEQ ID Nos. 486 and 487 in a suitable host cell, this polynucleotide being amplified each time the recombinant vector replicates. Generally, a recombinant vector of the invention may comprise any of the polynucleotides described herein, including regulatory sequences and coding sequences, as well as any MGST-II primer or probe as defined above.

A second preferred embodiment of the recombinant vectors according to the invention consists of expression vectors comprising either a regulatory polynucleotide or a coding nucleic acid of the invention, or both. Within certain embodiments, expression vectors are employed to express the MGST-II polypeptide which can be then purified and, for example be used in ligand screening assays or as an immunogen in order to raise specific antibodies directed against the MGST-II protein. In other embodiments, the expression vectors are used for constructing transgenic animals and also for gene therapy. Expression requires that appropriate signals are provided in the vectors, said signals including various regulatory elements, such as enhancers/promoters from both viral and mammalian sources that drive expression of the genes of interest in host cells. Dominant drug selection markers for establishing permanent, stable cell clones expressing the products are generally included in the expression vectors of the invention, as they are elements that link expression of the drug selection markers to expression of the polypeptide.

More particularly, the present invention relates to expression vectors which include nucleic acids encoding a MGST-II protein, preferably the MGST-II protein of the amino acid sequence of SEQ ID Nos. 488 and 489, under the control of a regulatory sequence selected among the MGST-II regulatory polynucleotides of SEQ ID Nos. 485 and 486, or alternatively under the control of an exogenous regulatory sequence. Consequently, preferred expression vectors of the invention are selected from the group consisting of: (a) the MGST-II regulatory sequence comprised therein drives the expression of a coding polynucleotide operably linked thereto; (b) the MGST-II coding sequence is operably linked to regulation sequences allowing its expression in a suitable cell host and/or host organism. Additionally, the recombinant expression vector described above may also comprise a nucleic acid comprising a 5'-regulatory polynucleotide or a 3'-regulatory polynucleotide, preferably a 5'-regulatory polynucleotide or a 3'-regulatory polynucleotide of the MGST-II gene. The MGST-II 5'-regulatory polynucleotide may also comprise the 5'-UTR sequence contained in the nucleotide sequence of SEQ ID Nos. 486 and 487; or a biologically active fragment or variant thereof. The invention also pertains to a recombinant expression vector useful for the expression of the MGST-II coding sequence, wherein said vector comprises any of the MGST-II cDNAs or cDNA variants described above; or fragments thereof.

Some of the elements which, can be found in the vectors of the present invention are described in further detail in the following sections.

1. General Features of the Expression Rectors of the Invention

A recombinant vector according to the invention comprises, but is not limited to, a YAC (Yeast Artificial Chromosome), a BAC (Bacterial Artificial Chromosome), a phage, a phagemid, a cosmid, a plasmid or even a linear DNA molecule which may consist of a chromosomal, non-chromosomal, semi-synthetic and synthetic DNA. Such a recombinant vector can comprise a transcriptional unit comprising an assembly of:

(1) a genetic element or elements having a regulatory role in gene expression, for example promoters or enhancers. Enhancers are cis-acting elements of DNA, usually from about 10 to 300 bp in length that act on the promoter to increase the transcription.

(2) a structural or coding sequence which is transcribed into mRNA and eventually translated into a polypeptide, said structural or coding sequence being operably linked to the regulatory elements described in (1); and (3) appropriate transcription initiation and termination sequences. Structural units intended for use in yeast or eukaryotic expression systems preferably include a leader sequence enabling extracellular secretion of translated protein by a host cell. Alternatively, when a recombinant protein is expressed without a leader or transport sequence, it may include a N-terminal residue. This residue may or may not be subsequently cleaved from the expressed recombinant protein to provide a final product.

Generally, recombinant expression vectors will include origins of replication, selectable markers permitting transformation of the host cell, and a promoter derived from a highly expressed gene to direct transcription of a downstream structural sequence. The heterologous structural sequence is assembled in appropriate phase with translation initiation and termination sequences, and preferably a leader sequence capable of directing secretion of the translated protein into the periplasmic space or the extracellular medium. In a specific embodiment wherein the vector is adapted for transfecting and expressing desired sequences in mammalian host cells, preferred vectors will comprise an origin of replication in the desired host, a suitable promoter and enhancer, and also any necessary ribosome binding sites, polyadenylation site, splice donor and acceptor sites, transcriptional termination sequences, and 5'-flanking non-transcribed sequences. DNA sequences derived from the SV40 viral genome, for example SV40 origin, early promoter, enhancer, splice and polyadenylation sites may be used to provide the required non-transcribed genetic elements.

The in vivo expression of a MGST-II polypeptide of SEQ ID Nos. 488 and 489 may be useful in order to correct a genetic defect related to the expression of the native gene in a host organism or to the production of a biologically inactive MGST-II protein.

Consequently, the present invention also deals with recombinant expression vectors mainly designed for the in vivo production of the MGST-II polypeptide of SEQ ID Nos. 488 and 489 or fragments or variants thereof by the introduction of the appropriate genetic material in the organism of the patient to be treated. This genetic material may be introduced in vitro in a cell that has been previously extracted from the organism, the modified cell being subsequently reintroduced in the said organism, directly in vivo into the appropriate tissue.

2. Regulatory Elements

Promoters

The suitable promoter regions used in the expression vectors according to the present invention are chosen taking into account the cell host in which the heterologous gene has to be expressed. The particular promoter employed to control the expression of a nucleic acid sequence of interest is not believed to be important, so long as it is capable of directing the expression of the nucleic acid in the targeted cell. Thus, where a human cell is targeted, it is preferable to position the nucleic acid coding region adjacent to and under the control of a promoter that is capable of being expressed in a human cell, such as, for example, a human or a viral promoter.

A suitable promoter may be heterologous with respect to the nucleic acid for which it controls the expression or alternatively can be endogenous to the native polynucleotide containing the coding sequence to be expressed.

Additionally, the promoter is generally heterologous with respect to the recombinant vector sequences within which the construct promoter/coding sequence has been inserted.

Promoter regions can be selected from any desired gene using, for example, CAT (chloramphenicol transferase) vectors and more preferably pKK232-8 and pCM7 vectors.

Preferred bacterial promoters are the LacI, LacZ, the T3 or T7 bacteriophage RNA polymerase promoters, the gpt, lambda PR, PL and trp promoters (EP 0036776), the polyhedrin promoter, or the p10 protein promoter from baculovirus (Kit Novagen) (Smith et al., 1983; O'Reilly et al., 1992), the lambda PR promoter or also the trc promoter.

Eukaryotic promoters include CMV immediate early, HSV thymidine kinase, early and late SV40, LTRs from retrovirus, and mouse metallothionein-L. Selection of a convenient vector and promoter is well within the level of ordinary skill in the art.

The choice of a promoter is well within the ability of a person skilled in the field of genetic egineering. For example, one may refer to the book of Sambrook et al. (*Molecular Cloning: A Laboratory Manual*, 2nd edition, Cold Spring Harbor Laboratory, Cold Spring Harbor, N.Y., 1989).

Other Regulatory Elements

Where a cDNA insert is employed, one will typically desire to include a polyadenylation signal to effect proper polyadenylation of the gene transcript. The nature of the polyadenylation signal is not believed to be crucial to the successful practice of the invention, and any such sequence may be employed such as human growth hormone and SV40 polyadenylation signals. Also contemplated as an element of the expression cassette is a terminator. These elements can serve to enhance message levels and to minimize read through from the cassette into other sequences.

The vector containing the appropriate DNA sequence as described above, more preferably MGST-II gene regulatory polynucleotide, a polynucleotide encoding the MGST-II polypeptides of SEQ ID Nos. 488 and 489 or both of them, can be utilized to transform an appropriate host to allow the expression of the desired polypeptide or polynucleotide.

3. Selectable Markers

Such markers would confer an identifiable change to the cell permitting easy identification of cells containing the expression construct. The selectable marker genes for selection of transformed host cells are preferably dihydrofolate reductase or neomycin resistance for eukaryotic cell culture, TRP 1 for *S. cerevisiae* or tetracycline, rifampicin or ampicillin resistance in *E. coli*, or levan saccharase for mycobacteria, this latter marker being a negative selection marker.

4. Preferred Vectors

Bacterial Vectors

As a representative but non-limiting example, useful expression vectors for bacterial use can comprise a selectable marker and a bacterial origin of replication derived from commercially available plasmids comprising genetic elements of pBR322 (ATCC 37017). Such commercial vectors include, for example, pKK223-3 (Pharmacia, Uppsala, Sweden), and GEM1 (Promega Biotec, Madison, Wis., USA). Large numbers of other suitable vectors are known to those of skill in the art, and commercially available, such as the following bacterial vectors: pQE70, pQE60, pQE-9 (Qiagen), pbs, pD10, phagescript, psiX174, pbluescript SK, pbsks, pNH8A, pNH16A, pNH18A, pNH46A (Stratagene); ptrc99a, pKK223-3, pKK233-3, pDR540, pRIT5 (Pharmacia); pWLNEO, pSV2CAT, pOG44, pXT1, pSG (Stratagene); pSVK3, pBPV, pMSG, pSVL (Pharmacia); pQE-30 (QLAexpress).

Bacteriophage Vectors

The P1 bacteriophage vector may contain large inserts ranging from about 80 to about 100 kb. The construction of P1 bacteriophage vectors such as p158 or p158/neo8 have been described by Sternberg (*Mamm. Genome*, 5:397404, 1994). Recombinant P1 clones comprising MGST-II nucleotide sequences may be designed for inserting large polynucleotides of more than 40 kb (Linton et al., *J. Clin. Invest.*, 92:3029–3037, 1993). To generate P1 DNA for transgenic experiments, a preferred protocol is the protocol described by McCormick et al. (*Genet. Anal. Tech. Appl.*, 11:158–164, 1994). Briefly, *E. coli* (preferably strain NS3529) harboring the P1 plasmid are grown overnight in a suitable broth medium containing 25 µg/ml of kanamycin. The P1 DNA is prepared from the *E. coli* by alkaline lysis using the Qiagen Plasmid Maxi kit (Qiagen, Chatsworth, Calif., USA), according to the manufacturer's instructions. The P1 DNA is purified from the bacterial lysate on two Qiagen-tip 500 columns, using the washing and elution buffers contained in the kit. A phenol/chloroform extraction is then performed before precipitating the DNA with 70% ethanol. After solubilizing the DNA in TE (10 mM Tris-HCl, pH 7.4, 1 mM EDTA), the concentration of the DNA is assessed by spectrophotometry.

When the goal is to express a P1 clone comprising MGST-II nucleotide sequences in a transgenic animal, typically in transgenic mice, it is desirable to remove vector sequences from the P1 DNA fragment, for example by cleaving the P1 DNA at rare-cutting sites within the P1 polylinker (SfiI, NotI or SalI). The P1 insert is then purified from vector sequences on a pulsed-field agarose gel, using methods similar using methods similar to those originally reported for the isolation of DNA from YACs (Schedl et al., 1993a; Peterson et al., 1993). At this stage, the resulting purified insert DNA can be concentrated, if necessary, on a Millipore Ultrafree-MC Filter Unit (Millipore, Bedford, Mass., USA—30,000 molecular weight limit) and then dialyzed against microinjection buffer (10 mM Tris-HCl, pH 7.4; 250 µM EDTA) containing 100 mM NaCl, 30 µM spermine, 70 µM spermidine on a microdyalisis membrane (type VS, 0.025 µM from Millipore). The intactness of the purified P1 DNA insert is assessed by electrophoresis on 1% agarose (Sea Kem GTG; FMC Bio-products) pulse-field gel and staining with ethidium bromide.

Baculovirus Vectors

A suitable vector for the expression of the MGST-II polypeptides of SEQ ID Nos. 488 and 489 is a baculovirus vector that can be propagated in insect cells and in insect cell lines. A specific suitable host vector system is the pVL1392/1393 baculovirus transfer vector (Pharmingen) that is used to transfect the SF9 cell line (ATCC N° CRL 1711) which is derived from *Spodoptera frugiperda*.

Other suitable vectors for the expression of the MGST-II polypeptides of SEQ ID Nos. 488 and 489 in a baculovirus expression system include those described by Chai et al. (*Biotech. Appl. Biochem.*, 18:259–273, 1993), Vlasak et al. (*Eur. J. Biochem.*, 135: 123–126, 1983) and Lenhard et al. (*Gene*, 169: 187–190, 1996).

Viral Vectors

Retrovirus vectors and adeno-associated virus vectors are generally understood to be the recombinant gene delivery systems of choice for the transfer of exogenous polynucleotides in vivo, particularly to mammals, including humans. These vectors provide efficient delivery of genes into cells, and the transferred nucleic acids are stably integrated into the chromosomal DNA of the host.

Particularly preferred retroviruses for the preparation or construction of retroviral in vitro or in vitro gene delivery vehicles of the present invention include retroviruses selected from the group consisting of Mink-Cell Focus Inducing Virus, Murine Sarcoma Virus, Reticuloendotheliosis virus and Rous Sarcoma virus. Particularly preferred Murine Leukemia Viruses include the 4070A and the 1504A viruses, Abelson (ATCC No VR-999), Friend (ATCC No VR-245), Gross (ATCC No. VR-590), Rauscher (ATCC No VR-998) and Moloney Murine Leukemia Virus (ATCC No VR-190; PCT Application No WO 94/24298). Particularly preferred Rous Sarcoma Viruses include Bryan high titer (ATCC Nos. VR-334, VR-657, VR-726, VR-659 and VR-728). Other preferred retroviral vectors are those described in Roth et al. (*Nature Medicine,* 2:985–991, 1996), PCT Application No. WO 93/25234 and PCT Application No. WO 94/06920.

Yet another viral vector system that is contemplated by the invention consists in the adeno-associated virus (AAV). The adeno-associated virus is a naturally occurring defective virus that requires another virus, such as an adenovirus or a herpes virus, as a helper virus for efficient replication and a productive life cycle (Muzyczka et al., *Current Topics in Microbiol. Immunol.,* 158:97–129, 1992). It is also one of the few viruses that may integrate its DNA into non-dividing cells, and exhibits a high frequency of stable integration (McLaughlin et al., *Am. J. Hum. Genet.,* 59: 561–569, 1989). One advantageous feature of AAV derives from its reduced efficacy for transducing primary cells relative to transformed cells. BAC vectors:

The bacterial artificial chromosome (BAC) cloning system (Shizuya et al., 1992) has been developed to stably maintain large fragments of genomic DNA (100–300 kb) in *E. coli*. A preferred BAC vector consists of pBeloBAC11 vector that has been described by Kim et al. (*Genomics,* 34:213–218,1996). BAC libraries are prepared with this vector using size-selected genomic DNA that has been partially digested using enzymes that permit ligation into either the Bam HI or HindIII sites in the vector. Flanking these cloning sites are T7 and SP6 RNA polymerase transcription initiation sites that can be used to generate end probes by either RNA transcription or PCR methods. After the construction of a BAC library in *E. coli*, BAC DNA is purified from the host cell as a supercoiled circle. Converting these circular molecules into a linear form precedes both size determination and introduction of the BACs into recipient cells. The cloning site is flanked by two Not I sites, permitting cloned segments to be excised from the vector by Not I digestion. Alternatively, the DNA insert contained in the pBeloBAC11 vector may be linearized by treatment of the BAC vector with the commercially available enzyme lambda terminase that leads to the cleavage at the unique cosN site, but this cleavage method results in a full length BAC clone containing both the insert DNA and the BAC sequences.

5. Delivery of the Recombinant Vectors

In order to effect expression of the polynucleotides and polynucleotide constructs of the invention, these constructs must be delivered into a cell. This delivery may be accomplished in vitro, as in laboratory procedures for transforming cell lines, or in vivo or ex vivo, as in the treatment of certain diseases states. One mechanism is viral infection where the expression construct is encapsidated in an infectious viral particle. Several non-viral methods for the transfer of polynucleotides into cultured mammalian cells are also contemplated by the present invention, and include, without being limited to, calcium phosphate precipitation (Chen et al., *Proc. Natl. Acad. Sci. USA,* 94:10756–10761, 1987), DEAE-dextran (Gopal, *Mol. Cell. Biol.,* 5:1188–1190, 1985), electroporation (Tur-Kaspa et al., *Mol. Cell. Biol.,* 6:716–7181986), direct microinjection (Harland et al., 1985), DNA-loaded liposomes (Nicolau et al., 1982; Fraley et al., 1979), and receptor-mediate transfection (Wu and Wu, 1987; 1988). Some of these techniques may be successfully adapted for in vivo or ex vivo use.

Once the expression polynucleotide has been delivered into the cell, it may be stably integrated into the genome of the recipient cell. This integration may be in the cognate location and orientation via homologous recombination (gene replacement) or it may be integrated in a random, non-specific location (gene augmentation). In yet further embodiments, the nucleic acid may be stably maintained in the cell as a separate, episomal segment of DNA. Such nucleic acid segments or "episomes" encode sequences sufficient to permit maintenance and replication independent of or in synchronization with the host cell cycle.

One specific embodiment for a method for delivering a protein or peptide to the interior of a cell of a vertebrate in vivo comprises the step of introducing a preparation comprising a physiologically acceptable carrier and a naked polynucleotide operatively coding for the polypeptide of interest into the interstitial space of a tissue comprising the cell, whereby the naked polynucleotide is taken up into the interior of the cell and has a physiological effect. This is particularly applicable for transfer in vitro but it may be applied to in vivo as well.

Compositions for use in vitro and in vivo comprising a "naked" polynucleotide are described in PCT application No. WO 90/11092 (Vical Inc.) and also in PCT application No. WO 95/11307.

In still another embodiment of the invention, the transfer of a naked polynucleotide of the invention, including a polynucleotide construct of the invention, into cells may be proceeded with a particle bombardment (biolistic), said particles being DNA-coated microprojectiles accelerated to a high velocity allowing them to pierce cell membranes and enter cells without killing them, such as described by Klein et al. (*Nature* 327:70–73, 1987).

In a further embodiment, the polynucleotide of the invention may be entrapped in a liposome (Ghosh and Bacchawat, *Targeting of liposomes to hepatocytes, In: Liver Diseases, Targeted diagnosis and therapy using specific rceptors and ligands,* Marcel Dekeker, New York, 87–104, 1991; Wong et al., *Gene* 10:87–94, 1980; Nicolau et al., *Biochim. Biophys. Acta.* 721:185–190, 1982).

In a specific embodiment, the invention provides a composition for the in vivo production of the MGST-II protein or polypeptide described herein. It comprises a naked polynucleotide operatively coding for this polypeptide, in solution in a physiologically acceptable carrier, and suitable for introduction into a tissue to cause cells of the tissue to express the said protein or polypeptide.

The amount of vector to be injected to the desired host organism varies according to the site of injection. As an indicative dose, it will be injected between 0.1 and 100 μg of the vector in an animal body, preferably a mammal body, for example a mouse body.

In another embodiment of the invention, the vector may be introduced in vitro in a host cell, preferably in a host cell previously harvested from the animal to be treated and more preferably a somatic cell such as a muscle cell. In a subsequent step, the cell that has been transformed with the vector coding for the desired MGST-II polypeptide or the desired fragment thereof is reintroduced into the animal body in order to deliver the recombinant protein within the body either locally or systemically.

Host Cells

Another embodiment of the invention consists of a host cell that has been transformed or transfected with one of the polynucleotides described therein, and more precisely a polynucleotide either comprising a MGST-II regulatory polynucleotide or the coding sequence of the MGST-II polypeptide having the amino acid sequence of SEQ ID Nos. 488 and 489. The embodiment includes host cells that are transformed (prokaryotic cells) or that are transfected (eukaryotic cells) with a recombinant vector such as one of those described above. Generally, a recombinant host cell of the invention comprises any one of the polynucleotides or the recombinant vectors described therein.

A preferred recombinant host cell according to the invention comprises a polynucleotide selected from the following group of polynucleotides:

a) a purified or isolated nucleic acid encoding a MGST-II polypeptide, or a polypeptide fragment or variant thereof.

b) a purified or isolated nucleic comprising at least 8, preferably at least 15, more preferably at least 25, consecutive nucleotides of the nucleotide sequence SEQ ID No. 485, a nucleotide sequence complementary thereto, or a variant thereof.

c) a purified or isolated nucleic acid comprising at least 8 consecutive nucleotides, preferably at least 15, more preferably at least 25 of the nucleotide sequence SEQ ID Nos. 486 and 487, a nucleotide sequence complementary thereto or a variant thereof.

d) a purified or isolated nucleic acid comprising an exon of the MGST-II gene, a sequence complementary thereto or a fragment or a variant thereof.

e) a purified or isolated nucleic acid comprising a combination of at least two exons of the MGST-II gene, or the sequences complementary thereto wherein the polynucleotides are arranged within the nucleic acid, from the 5' end to the 3' end of said nucleic acid, in the same order than in SEQ ID No. 485.

f) a purified or isolated nucleic acid comprising the nucleotide sequence SEQ ID No. 485 or the sequences complementary thereto or a biologically active fragment thereof.

g) a purified or isolated nucleic acid comprising the nucleotide sequence SEQ ID No. 486, or the sequence complementary thereto or a biologically active fragment thereof.

h) a polynucleotide consisting of:
   (1) a nucleic acid comprising a regulatory polynucleotide of SEQ ID No. 485 or the sequences complementary thereto or a biologically active fragment thereof
   (2) a polynucleotide encoding a desired polypeptide or nucleic acid.
   (3) Optionally, a nucleic acid comprising a regulatory polynucleotide of SEQ ID No. 485, or the sequence complementary thereto or a biologically active fragment thereof.

i) a DNA construct as described previously in the present specification.

Another preferred recombinant cell host according to the present invention is characterized in that its genome or genetic background (including chromosome, plasmids) is modified by the nucleic acid coding for the MGST-II polypeptide of SEQ ID Nos. 488 and 489 or fragments or variants thereof.

Preferred host cells used as recipients for the expression vectors of the invention are the following:

a) Prokaryotic host cells: *Escherichia coli* strains (I.E. DH5-α strain), *Bacillus subtilis, Salmonella typhimurium,* and strains from species like Pseudomonas, Streptomyces and Staphylococcus..

b) Eukaryotic host cells: HeLa cells (ATCC N° CCL2; N° CCL2.1; N° CCL2.2), Cv 1 cells (ATCC N° CCL70), COS cells (ATCC N° CRL1650; N° CRL1651), Sf-9 cells (ATCC N° N° CRL1711), C127 cells (ATCC N° CRL-1804), 3T3 (ATCC N° CRL-6361), CHO (ATCC N° CCL-61), human kidney 293.(ATCC N° 45504; N° CRL-1573) and BHK (ECACC N° 84100501; N° 84111301)

c) Other mammalian host cells:

The MGST-II gene expression in mammalian, and typically human, cells may be rendered defective, or alternatively it may be proceeded with the insertion of a MGST-II genomic or cDNA sequence with the replacement of the MGST-II gene counterpart in the genome of an animal cell by a MGST-II polynucleotide according to the invention. These genetic alterations may be generated by homologous recombination events using specific DNA constructs that have been previously described.

One kind of cell host that is commonly used is mammal zygotes, such as murine zygotes. For example, murine zygotes may undergo microinjection with a purified DNA molecule of interest, for example a purified DNA molecule that has previously been adjusted to a concentration range from 1 ng/ml (for BAC inserts) 3 ng/µl (for P1 bacteriophage inserts) in 10 mM Tris-HCl, pH 7.4, 250 µM EDTA containing 100 mM NaCl, 30 µM spermine,and 70 µM spermidine. When the DNA to be microinjected has a large size, polyamines and high salt concentrations can be used in order to avoid mechanical breakage of this DNA, as described by Schedl et al (*Nucleic Acids Res.* 21:47834787, 1993).

Anyone of the polynucleotides of the invention, including the DNA constructs described herein, may be introduced in an embryonic stem (ES) cell line, preferably a mouse ES cell line. ES cell lines are derived from pluripotent, uncommitted cells of the inner cell mass of pre-implantation blastocysts. Preferred ES cell lines are the following: ES-E14TG2a (ATCC n° CRL-1821), ES-D3 (ATCC n° CRL1934 and n° CRL-11632), YS001 (ATCC n° CRL-11776), 36.5 (ATCC n° CRL-11116). To maintain ES cells in an uncommitted state, they are cultured in the presence of growth inhibited feeder cells which, provide the appropriate signals to preserve this embryonic phenotype and serve as a matrix for ES cell adherence. Preferred feeder cells consist of primary embryonic fibroblasts that are established from tissue of day 13-day 14 embryos of virtually any mouse strain, that are maintained in culture, such as described by Abbondanzo et al. (*Methods in Enzymology,* Academic Press, NewYork, 803–823, 1993) and are inhibited in growth by irradiation, such as described by Robertson ("Embryo-Derived Stem-Cell Lines," E. J. Robertson Ed. *Teratocarcinomas and Embrionic Stem Cells: A Practical Approach.* IRL Press, Oxford, 71, 1987), or by the presence of an inhibitory concentration of LIF, such as described by Pease and Williams (*Exp. Cell. Res.* 190:09–211, 1990).

The constructs in the host cells can be used in a conventional manner to produce the gene product encoded by the recombinant sequence.

Following transformation of a suitable host and growth of the host to an appropriate cell density, the selected promoter is induced by appropriate means, such as temperature shift or chemical induction, and cells are cultivated for an additional period.

Cells are typically harvested by centrifugation, disrupted by physical or chemical means, and the resulting crude extract retained for further purification.

Microbial cells employed in the expression of proteins can be disrupted by any convenient method, including freeze-thaw cycling, sonication, mechanical disruption, or use of cell lysing agents. Such methods are well known by one skilled in the art.

Transgenic Animals

The terms "transgenic animals" or "host animals" are used herein designate animals that have their genome genetically and artificially manipulated so as to include one of the nucleic acids according to the invention. Preferred animals are non-human mammals and include those belonging to a genus selected from Mus (e.g. mice), Rattus (e.g. rats) and Oryctogalus (e.g. rabbits) which have their genome artificially and genetically altered by the insertion of a nucleic acid according to the invention.

The transgenic animals of the invention all include within a plurality of their cells a cloned recombinant or synthetic DNA sequence, more specifically one of the purified or isolated nucleic acids comprising a MGST-II coding sequence, a MGST-II regulatory polynucleotide or a DNA sequence encoding an antisense polynucleotide such as described in the present specification.

Preferred transgenic animals according to the invention contains in their somatic cells and/or in their germ line cells a polynucleotide selected from the following group of polynucleotides:

a) a purified or isolated nucleic acid encoding a MGST-II polypeptide, or a polypeptide fragment or variant thereof.

b) a purified or isolated nucleic comprising at least 8, preferably at least 15, more preferably at least 25, consecutive nucleotides of the nucleotide sequence SEQ ID No. 485, a nucleotide sequence complementary thereto.

c) a purified or isolated nucleic acid comprising at least 8 consecutive nucleotides, preferably at least 15, more preferably at least 25 of the nucleotide sequence SEQ ID Nos. 486 and 487, a nucleotide sequence complementary thereto.

d) a purified or isolated nucleic acid comprising an exon of the MGST-II gene, a sequence complementary thereto or a fragment or a variant thereof.

e) a purified or isolated nucleic acid comprising a combination of at least two exons of the MGST-II gene, or the sequences complementary thereto wherein the polynucleotides are arranged within the nucleic acid, from the 5' end to the 3' end of said nucleic acid, in the same order than in SEQ ID No. 485.

f) a purified or isolated nucleic acid comprising the nucleotide sequence SEQ ID No. 485 or the sequences complementary thereto or a biologically active fragment thereof.

g) a purified or isolated nucleic acid comprising the nucleotide sequence SEQ ID No. 486, or the sequence complementary thereto or a biologically active fragment thereof.

h) a polynucleotide consisting of:
  (1) a nucleic acid comprising a regulatory polynucleotide of SEQ ID No. 485 or the sequences complementary thereto or a biologically active fragment thereof
  (2) a polynucleotide encoding a desired polypeptide or nucleic acid.
  (3) Optionally, a nucleic acid comprising a regulatory polynucleotide of SEQ ID No. 486, or the sequence complementary thereto or a biologically active fragment thereof.

i) a DNA construct as described previously in the present specification.

The transgenic animals of the invention thus contain specific sequences of exogenous genetic material such as the nucleotide sequences described above in detail.

In a first preferred embodiment, these transgenic animals may be good experimental models in order to study the diverse pathologies related to cell differentiation, in particular concerning the transgenic animals within the genome of which has been inserted one or several copies of a polynucleotide encoding a native MGST-II protein, or alternatively a mutant MGST-II protein.

In a second preferred embodiment, these transgenic animals may express a desired polypeptide of interest under the control of the regulatory polynucleotides of the MGST-II gene, leading to good yields in the synthesis of this protein of interest, and eventually a tissue specific expression of this protein of interest.

The design of the transgenic animals of the invention may be made according to the conventional techniques well known from the one skilled in the art. For more details regarding the production of transgenic animals, and specifically transgenic mice, it may be referred to U.S. Pat. Nos. 4,873,191, issued Oct. 10, 1989, U.S. Pat. No. 5,464,764 issued Nov. 7, 1995 and U.S. Pat. No. 5,789,215, issued Aug. 4, 1998, these documents being herein incorporated by reference to disclose methods producing transgenic mice.

Transgenic animals of the present invention are produced by the application of procedures which result in an animal with a genome that has incorporated exogenous genetic material. The procedure involves obtaining the genetic material, or a portion thereof, which encodes either a MGST-II coding sequence, a MGST-II regulatory polynucleotide or a DNA sequence encoding a MGST-II antisense polynucleotide such as described in the present specification.

A recombinant polynucleotide of the invention is inserted into an embryonic or ES stem cell line. The insertion is preferably made using electroporation, such as described by Thomas et al. (*Cell* 51:503–512, 1987). The cells subjected to electroporation are screened (e.g. by selection via selectable markers, by PCR or by Southern blot analysis) to find positive cells which have integrated the exogenous recombinant polynucleotide into their genome, preferably via an homologous recombination event. An illustrative positive-negative selection procedure that may be used according to the invention is described by Mansour et al. (*Nature* 336:348–352, 1988).

Then, the positive cells are isolated, cloned and injected into 3.5 days old blastocysts from mice, such as described by Bradley ("Production and Analysis of Chimaeric Mice," *E. J. Robertson (Ed), Teratocarcinomas and embryonic stem cells: A practical approach* IRL Press, Oxford, 113, 1987). The blastocysts are then inserted into a female host animal and allowed to grow to term.

Alternatively, the positive ES cells are brought into contact with embryos at the 2.5 days old 8–16 cell stage (morulae) such as described by Wood et al. (*Proc. Natl. Acad. Sci. U.S.A.* 90:4582–4585, 1993) or by Nagy et al. (*Proc. Natl. Acad. Sci. USA.* 90: 8424–8428, 1993), the ES cells being internalized to colonize extensively the blastocyst including the cells which will give rise to the germ line.

The offspring of the female host are tested to determine which animals are transgenic e.g. include the inserted exogenous DNA sequence and which are wild-type. Thus, the present invention also concerns a transgenic animal containing a nucleic acid, a recombinant expression vector or a recombinant host cell according to the invention.

A further object of the invention consists of recombinant host cells obtained from a transgenic animal described herein.

Recombinant cell lines may be established in vitro from cells obtained from any tissue of a transgenic animal according to the invention, for example by transfection of primary cell cultures with vectors expressing onc-genes such as SV40 large T antigen, as described by Chou (*Mol. Endocrinol.* 3:1511–1514, 1989) and Shay et al. (*Biochem. Biophys. Acta.* 1072:1–7, 1991).

E. MGST-II Polypeptides

The term "MGST-II polypeptides" is used herein to embrace all of the proteins and polypeptides of the present invention. Also forming part of the invention are polypeptides encoded by the polynucleotides of the invention, as well as fusion polypeptides comprising such polypeptides. The invention embodies MGST-II proteins from humans, including isolated or purified MGST-II proteins consisting, consisting essentially, or comprising the sequence of SEQ ID Nos. 488 and 489. It should be noted the MGST-II proteins of the invention are based on the naturally-occurring variants of the amino acid sequence of human MGST-II.

In a first embodiment, the present invention provides a variant MGST-II protein; wherein the Tyr residue of amino acid position 93 has been replaced with a His residue. Variant proteins and the fragments thereof which contain amino acid position 93 are collectively referred to herein as "93-His variants." More particularly, the present invention embodies isolated, purified, and recombinant polypeptides comprising a contiguous span of at least 6 amino acids, preferably at least 8 to 10 amino acids, more preferably at least 12, 15, 20, 25, 30, 40, 50, or 100 amino acids of SEQ ID No. 488, wherein said contiguous span comprises a His residue at amino acid position 93. In this amino acid substitution the original residue (Tyr) is replaced by a non-equivalent amino acid (His) presenting different chemical properties.

The present invention further provides another naturally-occurring variant of the MGST-II protein that consists or consists essentially of amino acids 1–109 of SEQ ID No. 488. This variant MGST-II polypeptide corresponds to one allele of biallelic marker 10–290–37.

Another naturally-occurring variant of the MGST-II protein of the present invention is encoded by a cDNA obtained by alternative splicing. MGST-II cDNAs and cDNA variants are further described above. This variant polypeptide of a sequence from SEQ ID No. 489 is identical to the MGST-II protein of SEQ ID No. 488 from amino acid position 1 to amino acid position 19 but comprises 11 additional amino acids. The present invention embodies isolated, purified, and recombinant polypeptides comprising, consisting of or consisting essentially of an amino acid sequence from SEQ ID No. 489. Moreover, the present invention embodies isolated, purified, and recombinant polypeptides comprising a contiguous span of at least 6 amino acids, preferably at least 8 to 10 amino acids, more preferably at least 12, 15, 20, 25, or 30 amino acids of SEQ ID No. 489, wherein said contiguous span comprises a least one of amino acid positions 20 to 30 of SEQ ID No. 489.

All the variant MGST-II polypeptides described above most probably show alterations in the activity, specificity and function of the MGST-II enzyme. In preferred embodiments the polypeptides of the present invention comprise the site of a mutation or functional mutation, including a deletion, substitution or truncation in the amino acid sequence in the MGST-II protein.

MGST-II proteins are preferably isolated from human or mammalian tissue samples or expressed from human or mammalian genes. The MGST-II polypeptides of the invention can be made using routine expression methods known in the art. The polynucleotide encoding the desired polypeptide, is ligated into an expression vector suitable for any convenient host. Both eukaryotic and prokaryotic host systems are used in forming recombinant polypeptides. The polypeptide is then isolated from lysed cells or from the culture medium and purified to the extent needed for its intended use. Purification is by any technique known in the art, for example, differential extraction, salt fractionation, chromatography, centrifugation, and the like. See, for example, Methods in Enzymology for a variety of methods for purifying proteins.

In addition, shorter protein fragments are produced by chemical synthesis. Alternatively the proteins of the invention are extracted from cells or tissues of humans or non-human animals. Methods for purifying proteins are known in the art, and include the use of detergents or chaotropic agents to disrupt particles followed by differential extraction and separation of the polypeptides by ion exchange chromatography, affinity chromatography, sedimentation according to density, and gel electrophoresis.

Any MGST-II cDNA of the invention is used to express MGST-II proteins and polypeptides. The nucleic acid encoding the MGST-II protein or polypeptide to be expressed is operably linked to a promoter in an expression vector using conventional cloning technology. The MGST-II insert in the expression vector may comprise the full coding sequence for the MGST-II protein or a portion thereof. For example, the MGST-II derived insert may encode a polypeptide comprising a contiguous span of at least 6 amino acids, preferably at least 8 to 10 amino acids, more preferably at least 12, 15, 20, 25, 30, 40, 50, or 100 amino acids of SEQ ID No. 488, wherein said contiguous span comprises a His residue at amino acid position 93. The MGST-II derived insert may further encode a polypeptide comprising, consisting of or consisting essentially of an amino acid sequence from amino acid positions 1–108 of SEQ ID No. 488. The MGST-II derived insert may further encode a polypeptide comprising, consisting of or consisting essentially of an amino acid sequence from SEQ ID No. 489. The MGST-II derived insert may also encode a polypeptide comprising a contiguous span of at least 6 amino acids, preferably at least 8 to 10 amino acids, more preferably at least 12, 15, 20, 25,or 30 amino acids of SEQ ID No. 489, wherein said contiguous span comprises a least one of amino acid positions 20 to 30 of SEQ ID No. 489.

The expression vector is any of the mammalian, yeast, insect or bacterial expression systems known in the art. Commercially available vectors and expression systems are available from a variety of suppliers including Genetics Institute (Cambridge, Mass.), Stratagene (La Jolla, Calif.), Promega (Madison, Wis.), and Invitrogen (San Diego, Calif.). If desired, to enhance expression and facilitate proper protein folding, the codon context and codon pairing of the sequence is optimized for the particular expression organism in which the expression vector is introduced, as explained by Hatfield, et al., U.S. Pat. No. 5,082,767.

In one embodiment, the entire coding sequence of the MGST-II cDNA through the poly A signal of the cDNA is operably linked to a promoter in the expression vector. Alternatively, if the nucleic acid encoding a portion of the MGST-II protein lacks a methionine to serve as the initiation site, an initiating methionine can be introduced next to the first codon of the nucleic acid using conventional techniques. Similarly, if the insert from the MGST-II cDNA lacks a poly A signal, this sequence can be added to the construct by, for example, splicing out the Poly A signal from pSG5 (Stratagene) using BglI and SalI restriction endonuclease enzymes and incorporating it into the mammalian expression vector pXT1 (Stratagene). pXT1 contains the LTRs and a portion of the gag gene from Moloney Murine Leukemia Virus. The position of the LTRs in the construct allows efficient stable transfection. The vector includes the Herpes Simplex Thymidine Kinase promoter and the selectable neomycin gene. The nucleic acid encoding the MGST-II protein or a portion thereof is obtained by PCR from a bacterial vector containing a MGST-II cDNA of the present invention using oligonucleotide primers complementary to the MGST-II cDNA or portion thereof and containing restriction endonuclease sequences for Pst I incorporated into the 5' primer and Bgl II at the 5' end of the corresponding cDNA 3' primer, taking care to ensure that the sequence encoding the MGST-II protein or a portion thereof is positioned properly with respect to the poly A signal. The purified fragment obtained from the resulting PCR reaction is digested with PstI, blunt ended with an exonuclease, digested with Bgl II, purified and ligated to pXT1, now containing a poly A signal and digested with BglII.

The ligated product is transfected into mouse NIH 3T3 cells using Lipofectin (Life Technologies, Inc., Grand Island, N.Y.) under conditions outlined in the product specification. Positive transfectants are selected after growing the transfected cells in 600 ug/ml G418 (Sigma, St. Louis, Mo.).

Alternatively, the nucleic acids encoding the MGST-II protein or a portion thereof is cloned into pED6dpc2 (Genetics Institute, Cambridge, Mass.). The resulting pED6dpc2 constructs is transfected into a suitable host cell, such as COS 1 cells. Methotrexate resistant cells are selected and expanded.

The above procedures may also be used to express a mutant MGST-II protein responsible for a detectable phenotype or a portion thereof.

The expressed proteins are purified using conventional purification techniques such as ammonium sulfate precipitation or chromatographic separation based on size or charge. The protein encoded by the nucleic acid insert may also be purified using standard immunochromatography techniques. In such procedures, a solution containing the expressed MGST-II protein or portion thereof, such as a cell extract, is applied to a column having antibodies against the MGST-II protein or portion thereof is attached to the chromatography matrix. The expressed protein is allowed to bind the immunochromatography column. Thereafter, the column is washed to remove non-specifically bound proteins. The specifically bound expressed protein is then released from the column and recovered using standard techniques.

To confirm expression of the MGST-II protein or a portion thereof, the proteins expressed from host cells containing an expression vector containing an insert encoding the MGST-II protein or a portion thereof can be compared to the proteins expressed in host cells containing the expression vector without an insert. The presence of a band in samples from cells containing the expression vector with an insert which is absent in samples from cells containing the expression vector without an insert indicates that the MGST-II protein or a portion thereof is being expressed. Generally, the band will have the mobility expected for the MGST-II protein or portion thereof. However, the band may have a mobility different than that expected as a result of modifications such as glycosylation, ubiquitination, or enzymatic cleavage.

Antibodies capable of specifically recognizing the expressed MGST-II protein or a portion thereof, are described below.

If antibody production is not possible, the nucleic acids encoding the MGST-II protein or a portion thereof is incorporated into expression vectors designed for use in purification schemes employing chimeric polypeptides. In such strategies the nucleic acid encoding the MGST-II protein or a portion thereof is inserted in frame with the gene encoding the other half of the chimera. The other half of the chimera is β-globin or a nickel binding polypeptide encoding sequence. A chromatography matrix having antibody to β-globin or nickel attached thereto is then used to purify the chimeric protein. Protease cleavage sites is engineered between the β-globin gene or the nickel binding polypeptide and the MGST-II protein or portion thereof. Thus, the two polypeptides of the chimera are separated from one another by protease digestion.

One useful expression vector for generating β-globin chimerics is pSG5 (Stratagene), which encodes rabbit β-globin. Intron II of the rabbit β-globin gene facilitates splicing of the expressed transcript, and the polyadenylation signal incorporated into the construct increases the level of expression. These techniques are well known to those skilled in the art of molecular biology. Standard methods are published in methods texts such as Davis et al., (Basic Methods in Molecular Biology, L. G. Davis, M. D. Dibner, and J. F. Battey, ed., Elsevier Press, NY, 1986) and many of the methods are available from Stratagene, Life Technologies, Inc., or Promega. Polypeptide may additionally be produced from the construct using in vitro translation systems such as the In vitro Express™ Translation Kit (Stratagene).

F. Production of Antibodies Against MGST-II Polypeptides

Any MGST-II polypeptide or whole protein may be used to generate antibodies capable of specifically binding to expressed MGST-II protein or fragments thereof or variants thereof. Preferably the antibody compositions of the invention are capable of specifically binding to the 93-His variant of the MGST-II protein. Alternatively the antibody compositions of the present invention are capable of specifically binding the variant MGST-II polypeptide of SEQ ID No. 489. A preferred embodiment of the invention encompasses isolated or purified antibody compositions capable of selectively binding, or which are capable of binding to an epitope-containing fragment of a polypeptide of the invention, wherein said epitope comprises at least one amino acid position selected from the group consisting of His residue at amino acid position 93 of SEQ ID No. 488 and of amino acid positions 20–30 of SEQ ID No. 489. For an antibody composition to specifically bind to these MGST-II variants it must demonstrate at least a 5%, 10%, 15%, 20%, 25%, 50%, or 100% greater binding affinity for full length MGST-II variants in an ELISA, RIA, or other antibody-based binding assay than to full length MGST-II protein described in SEQ ID No. 488. Affinity of the antibody composition for the epitope can further be determined by preparing competitive binding curves, as described, for example, by Fisher, D. (Chap. 42 in: Manual of Clinical Immunology, 2d Ed. (Rose and Friedman,Eds.) Amer. Soc. For Microbiol., Washington, D.C., 1980).

The present invention also contemplates the use of variant MGST-II polypeptides in the manufacture of antibodies. In a preferred embodiment such polypeptides are useful in the manufacture of antibodies to detect the presence and absence of the 93-His variant and of the MGST-II variant of SEQ ID No. 489.

Non-human animals or mammals, whether wild-type or transgenic, which express a different species of MGST-II than the one to which antibody binding is desired, and animals which do not express MGST-II (i.e. an MGST-II knock out animal as described in herein) are particularly useful for preparing antibodies. MGST-II knock out animals will recognize all or most of the exposed regions of MGST-II as foreign antigens, and therefore produce antibodies with a wider array of MGST-II epitopes. Moreover, smaller polypeptides with only 10 to 30 amino acids may be useful in obtaining specific binding to the 93-His variant and to the MGST-II variant of SEQ ID No. 489. In addition, the humoral immune system of animals which produce a species of MGST-II that resembles the antigenic sequence will preferentially recognize the differences between the animal's native MGST-II species and the antigen sequence, and produce antibodies to these unique sites in the antigen sequence. Such a technique will be particularly useful in obtaining antibodies that specifically bind to the 93-His variant and to the MGST-II variant of SEQ ID No. 489. The preparation of antibody compositions is further described in Example 6.

Antibody preparations prepared according to the present invention are useful in quantitative immunoassays which determine concentrations of antigen-bearing substances in biological samples; they are also used semi-quantitatively or qualitatively to identify the presence of antigen in a biological sample. The antibodies may also be used in therapeutic compositions for killing cells expressing the protein or reducing the levels of the protein in the body. The antibodies of the invention may be labeled, either by a radioactive, a fluorescent or an enzymatic label. Consequently, the invention is also directed to a method for detecting specifically the presence of a variant MGST-II polypeptide according to the invention in a biological sample, said method comprising the following steps: a) bringing into contact the biological sample with a polyclonal or monoclonal antibody that specifically binds a variant MGST-II polypeptide or to a peptide fragment or variant thereof; and b) detecting the antigen-antibody complex formed. The invention also concerns a diagnostic kit for detecting in vitro the presence of a variant MGST-II polypeptide according to the present invention in a biological sample, wherein said kit comprises: a) a polyclonal or monoclonal antibody that specifically binds a variant MGST-II polypeptide or to a peptide fragment or variant thereof, optionally labeled; b) a reagent allowing the detection of the antigen-antibody complexes formed, said reagent carrying optionally a label, or being able to be recognized itself by a labeled reagent, more particularly in the case when the above-mentioned monoclonal or polyclonal antibody is not labeled by itself.

II. Methods for De Novo Identification of Biallelic Markers

Large fragments of human DNA, carrying genes of interest involved in the biotransformation of xenobiotics such as therapeutic drugs; were cloned, sequenced and screened for biallelic markers. Biallelic markers within the candidate genes themselves as well as markers located on the same genomic fragment were identified. It will be clear to one of skill in the art that large fragments of human genomic DNA may be obtained from any appropriate source and may be cloned into a number of suitable vectors.

In a preferred embodiment of the invention, BAC (Bacterial Artificial Chromosomes) vectors were used to construct DNA libraries covering the entire human genome. Specific amplification primers were designed for each candidate gene and the BAC library was screened by PCR until there was at least one positive BAC clone per candidate gene. Genomic sequence, screened for biallelic markers, was generated by sequencing ends of BAC subclones. Details of a preferred embodiment are provided in Example 1. As a preferred alternative to sequencing the ends of an adequate number of BAC subclones, high throughput deletion-based sequencing vectors, which allow the generation of a high quality sequence information covering fragments of about 6 kb, may be used. Having sequence fragments longer than 2.5 or 3 kb enhances the chances of identifying biallelic markers therein. Methods of constructing and sequencing a nested set of deletions are disclosed in the related U.S. patent application entitled "High Throughput DNA Sequencing Vector" (Ser. No. 09/058,746).

In another embodiment of the invention, genomic sequences of candidate genes were available in public databases allowing direct screening for biallelic markers.

Any of a variety of methods can be used to screen a genomic fragment for single nucleotide polymorphisms such as differential hybridization with oligonucleotide probes, detection of changes in the mobility measured by gel electrophoresis or direct sequencing of the amplified nucleic acid. A preferred method for identifying biallelic markers involves comparative sequencing of genomic DNA fragments from an appropriate number of unrelated individuals.

In a first embodiment, DNA samples from unrelated individuals are pooled together, following which the genomic DNA of interest is amplified and sequenced. The nucleotide sequences thus obtained are then analyzed to identify significant polymorphisms. One of the major advantages of this method resides in the fact that the pooling of the DNA samples substantially reduces the number of DNA amplification reactions and sequencing reactions, which must be carried out. Moreover, this method is sufficiently sensitive so that a biallelic marker obtained thereby usually demonstrates a sufficient frequency of its less common allele to be useful in conducting association studies. Usually, the frequency of the least common allele of a biallelic marker identified by this method is at least 10%.

In a second embodiment, the DNA samples are not pooled and are therefore amplified and sequenced individually. This method is usually preferred when biallelic markers need to be identified in order to perform association studies within candidate genes. Preferably, highly relevant gene regions such as promoter regions or exon regions may be screened for biallelic markers. A biallelic marker obtained using this method may show a lower degree of informativeness for conducting association studies, e.g. if the frequency of its less frequent allele may be less than about 10%. Such a biallelic marker will however be sufficiently informative to conduct association studies and it will further be appreciated that including less informative biallelic markers in the genetic analysis studies of the present invention, may allow in some cases the direct identification of causal mutations, which may, depending on their penetrance, be rare mutations.

The following is a description of the various parameters of a preferred method used by the inventors for the identification of the biallelic markers of the present invention.

A. Genomic DNA Samples

The genomic DNA samples from which the biallelic markers of the present invention are generated are preferably obtained from unrelated individuals corresponding to a heterogeneous population of known ethnic background. The number of individuals from whom DNA samples are obtained can vary substantially, preferably from about 10 to about 1000, more preferably from about 50 to about 200 individuals. Usually, DNA samples are collected from at least about 100 individuals in order to have sufficient polymorphic diversity in a given population to identify as many markers as possible and to generate statistically significant results.

As for the source of the genomic DNA to be subjected to analysis, any test sample can be foreseen without any particular limitation. These test samples include biological samples, which can be tested by the methods of the present invention described herein, and include human and animal body fluids such as whole blood, serum, plasma, cerebrospinal fluid, urine, lymph fluids, and various external secretions of the respiratory, intestinal and genitourinary tracts, tears, saliva, milk, white blood cells, myelomas and the like; biological fluids such as cell culture supernatants; fixed tissue specimens including tumor and non-tumor tissue and lymph node tissues; bone marrow aspirates and fixed cell specimens. The preferred source of genomic DNA used in the present invention is from peripheral venous blood of each donor. Techniques to prepare genomic DNA from biological samples are well known to the skilled technician. Details of a preferred embodiment are provided in Example 1. The person skilled in the art can choose to amplify pooled or unpooled DNA samples.

B. DNA Amplification

The identification of biallelic markers in a sample of genomic DNA may be facilitated through the use of DNA amplification methods. DNA samples can be pooled or unpooled for the amplification step. DNA amplification techniques are well known to those skilled in the art. Various methods to amplify DNA fragments carrying biallelic markers are further described hereinafter in III.B. The PCR technology is the preferred amplification technique used to identify new biallelic markers.

In a first embodiment, biallelic markers are identified using genomic sequence information generated by the inventors. Genomic DNA fragments, such as the inserts of the BAC clones described above, are sequenced and used to design primers for the amplification of 500 bp fragments. These 500 bp fragments are amplified from genomic DNA and are scanned for biallelic markers. Primers may be designed using the OSP software (Hillier L. and Green P., 1991), the disclosures of which are incorporated herein by reference in their entirety. All primers may contain, upstream of the specific target bases, a common oligonucleotide tail that serves as a sequencing primer. Those skilled in the art are familiar with primer extensions, which can be used for these purposes.

In another embodiment of the invention, genomic sequences of candidate genes are available in public databases allowing direct screening for biallelic markers. Preferred primers, useful for the amplification of genomic sequences encoding the candidate genes, focus on promoters, exons and splice sites of the genes. A biallelic marker present in these functional regions of the gene have a higher probability to be a causal mutation.

Preferred primers include those disclosed in Table 17.

C. Sequencing of Amplified Genomic DNA and Identification of Single Nucleotide Polymophisms The amplification products generated as described above, are then sequenced using any method known and available to the skilled technician. Methods for sequencing DNA using either the dideoxy-mediated method (Sanger method) or the Maxam-Gilbert method are widely known to those of ordinary skill in the art. Such methods are for example disclosed in Maniatis et al. (Molecular Cloning, A Laboratory Manual, Cold Spring Harbor Press, Second Edition, 1989), the disclosure of which is incorporated herein by reference in its entirety. Alternative approaches include hybridization to high-density DNA probe arrays as described in Chee et al. (*Science* 274, 610, 1996), the disclosure of which is incorporated herein by reference in its entirety.

Preferably, the amplified DNA is subjected to automated dideoxy terminator sequencing reactions using a dye-primer cycle sequencing protocol. The products of the sequencing reactions are run on sequencing gels and the sequences are determined using gel image analysis. The polymorphism search is based on the presence of superimposed peaks in the electrophoresis pattern resulting from different bases occurring at the same position. Because each dideoxy terminator is labeled with a different fluorescent molecule, the two peaks corresponding to a biallelic site present distinct colors corresponding to two different nucleotides at the same position on the sequence. However, the presence of two peaks can be an artifact due to background noise. To exclude such an artifact, the two DNA strands are sequenced and a comparison between the peaks is carried out. In order to be registered as a polymorphic sequence, the polymorphism has to be detected on, both strands.

The above procedure permits those amplification products, which contain biallelic markers to be identified. The detection limit for the frequency of biallelic polymorphisms detected by sequencing pools of 100 individuals is approximately 0.1 for the minor allele, as verified by sequencing pools of known allelic frequencies. However, more than 90% of the biallelic polymorphisms detected by the pooling method have a frequency for the minor allele higher than 0.25. Therefore, the biallelic markers selected by this method have a frequency of at least 0.1 for the minor allele and less than 0.9 for the major allele. Preferably at least 0.2 for the minor allele and less than 0.8 for the major allele, more preferably at least 0.3 for the minor allele 30 and less than 0.7 for the major allele, thus a heterozygosity rate higher than 0.18, preferably higher than 0.32, more preferably higher than 0.42.

In another embodiment, biallelic markers are detected by sequencing individual DNA samples, the frequency of the minor allele of such a biallelic marker may be less than 0.1.

The markers carried by the same fragment of genomic DNA, such as the insert in a BAC clone, need not necessarily be ordered with respect to one another within the genomic fragment to conduct association studies. However, in some embodiments of the present invention, the order of biallelic markers carried by the same fragment of genomic DNA are determined.

D. Validation of the Biallelic Markers of the Present Invention

The polymorphisms are evaluated for their usefulness as genetic markers by validating that both alleles are present in a population. Validation of the biallelic markers is accomplished by genotyping a group of individuals by a method of the invention and demonstrating that both alleles are present. Microsequencing is a preferred method of genotyping alleles. The validation by genotyping step may be performed on individual samples derived from each individual in the group or by genotyping a pooled sample derived from more than one individual. The group can be as small as one individual if that individual is heterozygous for the allele in question. Preferably the group contains at least three individuals, more preferably the group contains five or six individuals, so that a single validation test will be more likely to result in the validation of more of the biallelic markers that are being tested. It should be noted, however, that when the validation test is performed on a small group it may result in a false negative result if as a result of sampling error none of the individuals tested carries one of the two alleles. Thus, the validation process is less useful in demonstrating that a particular initial result is an artifact, than it is at demonstrating that there is a bonafide biallelic marker at a particular position in a sequence. For an indication of whether a particular biallelic marker has been validated see Table 11(A–B). All of the genotyping, haplotyping, association, and interaction study methods of the invention may optionally be performed solely with validated biallelic markers.

E. Evaluation of the Frequency of the Biallelic Markers of the Present Invention The validated biallelic markers are further evaluated for their usefulness as genetic markers by determining the frequency of the least common allele at the biallelic marker site. The determination of the least common allele is accomplished by genotyping a group of individuals by a method of the invention and demonstrating that both alleles are present. This determination of frequency by genotyping step may be performed on individual samples derived from each individual in the group or by genotyping a pooled sample derived from more than one individual. The group must be large enough to be representative of the population as a whole. Preferably the group contains at least 20 individuals, more preferably the group contains at least 50 individuals, most preferably the group contains at least 100 individuals. Of course the larger the group the greater the accuracy of the frequency determination because of reduced sampling error. For an indication of the frequency for the less common allele of a particular biallelic marker of the invention see Table 11(A–B). A biallelic marker wherein the frequency of the less common allele is 30% or more is termed a "high quality biallelic marker." All of the genotyping, haplotyping, association, and interaction study methods of the invention may optionally be performed solely with high quality biallelic markers.

III. Methods of Genotyping an Individual for Biallelic Markers

Methods are provided to genotype a biological sample for one or more biallelic markers of the present invention, all of which may be performed in vitro. Such methods of genotyping comprise determining the identity of a nucleotide at a DME-related biallelic marker by any method known in the art. These methods find use in genotyping case-control populations in association studies as well as individuals in the context of detection of alleles of biallelic markers which, are known to be associated with a given trait, in which case both copies of the biallelic marker present in individual's genome are determined so that an individual may be classified as homozygous or heterozygous for a particular allele.

These genotyping methods can be performed nucleic acid samples derived from a single individual or pooled DNA samples.

Genotyping can be performed using similar methods as those described above for the identification of the biallelic markers, or using other genotyping methods such as those further described below. In preferred embodiments, the comparison of sequences of amplified genomic fragments from different individuals is used to identify new biallelic markers whereas microsequencing is used for genotyping known biallelic markers in diagnostic and association study applications.

A. Source of DNA for Genotyping

Any source of nucleic acids, in purified or non-purified form, can be utilized as the starting nucleic acid, provided it contains or is suspected of containing the specific nucleic acid sequence desired. DNA or RNA may be extracted from cells, tissues, body fluids and the like as described above in II.A. "Genomic DNA Samples." While nucleic acids for use in the genotyping methods of the invention can be derived from any mammalian source, the test subjects and individuals from which nucleic acid samples are taken are generally understood to be human.

B. Amplification of DNA Fragments Comprising Biallelic Markers

Methods and polynucleotides are provided to amplify a segment of nucleotides comprising one or more biallelic marker of the present invention. It will be appreciated that amplification of DNA fragments comprising biallelic markers may be used in various methods and for various purposes and is not restricted to genotyping. Nevertheless, many genotyping methods, although not all, require the previous amplification of the DNA region carrying the biallelic marker of interest. Such methods specifically increase the concentration or total number of sequences that span the biallelic marker or include that site and sequences located either distal or proximal to it. Diagnostic assays may also rely on amplification of DNA segments carrying a biallelic marker of the present invention.

Amplification of DNA may be achieved by any method known in the art. The established PCR (polymerase chain reaction) method or by developments thereof or alternatives. Amplification methods which can be utilized herein include but are not limited to Ligase Chain Reaction (LCR) as described in EP A 320 308 and EP A 439 182, Gap LCR (Wolcott, M. J., Clin. Mcrobiol. Rev. 5:370–386), the so-called "NASBA" or "3SR" technique described in Guatelli J. C. et al. (*Proc. Natl. Acad. Sci. USA* 87:1874–1878, 1990) and in Compton J. (*Nature* 350:91–92, 1991), Q-beta amplification as described in European Patent Application no 4544610, strand displacement amplification as described in Walker et al. (*Clin. Chem.* 42:9–13, 1996) and EP A 684 315 and, target mediated amplification as described in PCT Publication WO 9322461, the disclosures of which are incorporated herein by reference in their entirety.

LCR and Gap LCR are exponential amplification techniques, both depend on DNA ligase to join adjacent primers annealed to a DNA molecule. In Ligase Chain Reaction (LCR), probe pairs are used which include two primary (first and second) and two secondary (third and fourth) probes, all of which are employed in molar excess to target. The first probe hybridizes to a first segment of the target strand and the second probe hybridizes to a second segment of the target strand, the first and second segments being contiguous so that the primary probes abut one another in 5' phosphate-3'hydroxyl relationship, and so that a ligase can covalently fuse or ligate the two probes into a fused product. In addition, a third (secondary) probe can hybridize to a portion of the first probe and a fourth (secondary) probe can hybridize to a portion of the second probe in a similar abutting fashion. Of course, if the target is initially double stranded, the secondary probes also will hybridize to the target complement in the first instance. Once the ligated strand of primary probes is separated from the target strand, it will hybridize with the third and fourth probes which can be ligated to form a complementary, secondary ligated product. It is important to realize that the ligated products are functionally equivalent to either the target or its complement. By repeated cycles of hybridization and ligation, amplification of the target sequence is achieved. A method for multiplex LCR has also been described (WO 9320227), the disclosure of which is incorporated herein by reference in its entirety. Gap LCR (GLCR) is a version of LCR where the probes are not adjacent but are separated by 2 to 3 bases.

For amplification of mRNAs, it is within the scope of the present invention to reverse transcribe mRNA into cDNA followed by polymerase chain reaction (RT-PCR); or, to use a single enzyme for both steps as described in U.S. Pat. No. 5,322,770 or, to use Asymmetric Gap LCR (RT-AGLCR) as described by Marshall R. L. et al. (*PCR Methods and Applications* 4:80–84, 1994), the disclosures of which are incorporated herein by reference in their entirety. AGLCR is a modification of GLCR that allows the amplification of RNA.

Some of these amplification methods are particularly suited for the detection of single nucleotide polymorphisms and allow the simultaneous amplification of a target sequence and the identification of the polymorphic nucleotide as it is further described in "IIIC. Methods of Genotyping DNA samples for Biallelic Markers."

The PCR technology is the preferred amplification technique used in the present invention. A variety of PCR techniques are familiar to those skilled in the art. For a review of PCR technology, see Molecular Cloning to Genetic Engineering White, B. A. Ed. in *Methods in Molecular Biology* 67: Humana Press, Totowa (1997) and the publication entitled "PCR Methods and Applications" (1991, Cold Spring Harbor Laboratory Press), the disclosure of which is incorporated herein by reference in its entirety. In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to produce an amplified fragment containing the nucleic acid sequence between the primer sites. PCR has further been described in several patents including U.S. Pat. Nos. 4,683,195, 4,683,202 and 4,965,188, the disclosures of which are incorporated herein by reference in their entirety.

The identification of biallelic markers as described above allows the design of appropriate oligonucleotides, which can be used as primers to amplify DNA fragments comprising the biallelic markers of the present invention. Amplification can be performed using the primers initially used to discover new biallelic markers which are described herein or any set of primers allowing the amplification of a DNA fragment comprising a biallelic marker of the present invention. Primers can be prepared by any suitable method. As for example, direct chemical synthesis by a method such as the phosphodiester method of Narang S. A. et al. (*Methods Enzymol.* 68:90–98, 1979), the phosphodiester method of Brown E. L. et al. (*Methods Enzymol.* 68:109–151, 1979), the diethylphosphoramidite method of Beaucage et al. (*Tetrahedron Lett.* 22:1859–1862, 1981) and the solid support method described in EP 0 707 592, the disclosures of which are incorporated herein by reference in their entirety.

In some embodiments the present invention provides primers for amplifying a DNA fragment containing one or more biallelic markers of the present invention. Preferred amplification primers are listed in Table 17. It will be appreciated that the primers listed are merely exemplary and that any other set of primers which produce amplification products containing one or more biallelic markers of the present invention.

The primers are selected to be substantially complementary to the different strands of each specific sequence to be amplified. The length of the primers of the present invention can range from 8 to 100 nucleotides, preferably from 8 to 50, 8 to 30 or more preferably 8 to 25 nucleotides. Shorter primers tend to lack specificity for a target nucleic acid sequence and generally require cooler temperatures to form sufficiently stable hybrid complexes with the template. Longer primers are expensive to produce and can sometimes self-hybridize to form hairpin structures. The formation of stable hybrids depends on the melting temperature (Tm) of the DNA. The Tm depends on the length of the primer, the ionic strength of the solution and the G+C content. The higher the G+C content of the primer, the higher is the melting temperature because G:C pairs are held by three H bonds whereas A:T pairs have only two. The G+C content of the amplification primers of the present invention preferably ranges between 10 and 75%, more preferably between 35 and 60%, and most preferably between 40 and 55%. The appropriate length for primers under a particular set of assay conditions may be empirically determined by one of skill in the art.

The spacing of the primers determines the length of the segment to be amplified. In the context of the present invention amplified segments carrying biallelic markers can range in size from at least about 25 bp to 35 kbp. Amplification fragments from 25–3000 bp are typical, fragments from 50–1000 bp are preferred and fragments from 100–600 bp are highly preferred. It will be appreciated that amplification primers for the biallelic markers may be any sequence which allow the specific amplification of any DNA fragment carrying the markers. Amplification primers may be labeled or immobilized on a solid support as described in I.

C. Methods of Genotyping DNA samples for Biallelic Markers

Any method known in the art can be used to identify the nucleotide present at a biallelic marker site. Since the biallelic marker allele to be detected has been identified and specified in the present invention, detection will prove simple for one of ordinary skill in the art by employing any of a number of techniques. Many genotyping methods require the previous amplification of the DNA region carrying the biallelic marker of interest. While the amplification of target or signal is often preferred at present, ultrasensitive detection methods which do not require amplification are also encompassed by the present genotyping methods. Methods well-known to those skilled in the art that can be used to detect biallelic polymorphisms include methods such as, conventional dot blot analyzes, single strand conformational polymorphism analysis (SSCP) described by Orita et al. (*Proc. Natl. Acad. Sci. U.S.A* 86:27776–2770, 1989), denaturing gradient gel electrophoresis (DGGE), heteroduplex analysis, mismatch cleavage detection, and other conventional techniques as described in Sheffield, V. C. et al. (*Proc. Natl. Acad. Sci. USA* 49:699–706, 1991), White et al. (*Genomics* 12:301–306, 1992), Grompe, M. et al. (*Proc. Natl. Acad. Sci. USA* 86:5855–5892, 1989) and Grompe, M. (Nature Genetics 5:111–117, 1993), the disclosures of which are incorporated herein by reference in their entirety. Another method for determining the identity of the nucleotide present at a particular polymorphic site employs a specialized exonuclease-resistant nucleotide derivative as described in U.S. Pat. No. 4,656,127, the disclosure of which is incorporated herein by reference in its entirety.

Preferred methods involve directly determining the identity of the nucleotide present at a biallelic marker site by sequencing assay, enzyme-based mismatch detection assay, or hybridization assay. The following is a description of some preferred methods. A highly preferred method is the microsequencing technique. The term "sequencing assay" is used herein to refer to polymerase extension of duplex primer/template complexes and includes both traditional sequencing and microsequencing.

Sequencing Assays

The nucleotide present at a polymorphic site can be determined by sequencing methods. In a preferred embodiment, DNA samples are subjected to PCR amplification before sequencing as described above. DNA sequencing methods are described in IIC.

Preferably, the amplified DNA is subjected to automated dideoxy terminator sequencing reactions using a dye-primer cycle sequencing protocol. Sequence analysis allows the identification of the base present at the biallelic marker site.

Microsequencing Assays

In microsequencing methods, a nucleotide at the polymorphic site that is unique to one of the alleles in a target DNA is detected by a single nucleotide primer extension reaction. This method involves appropriate microsequencing primers which, hybridize just upstream of a polymorphic base of interest in the target nucleic acid. A polymerase is used to specifically extend the 3' end of the primer with one single ddNTP (chain terminator) complementary to the selected nucleotide at the polymorphic site. Next the identity of the incorporated nucleotide is determined in any suitable way.

Typically, microsequencing reactions are carried out using fluorescent ddNTPs and the extended microsequencing primers are analyzed by electrophoresis on ABI 377 sequencing machines to determine the identity of the incorporated nucleotide as described in EP 412 883. Alternatively capillary electrophoresis can be used in order to process a higher number of assays simultaneously. An example of a typical microsequencing procedure that can be used in the context of the present invention is provided in Example 2.

Different approaches can be used to detect the nucleotide added to the microsequencing primer. A homogeneous phase detection method based on fluorescence resonance energy transfer has been described by Chen and Kwok (*Nucleic Acids Research* 25:347–353 1997) and Chen et al. (*Proc. Natl. Acad. Sci. USA* 94/20 10756–10761,1997), the disclosures of which are incorporated herein by reference in their entirety. In this method amplified genomic DNA fragments containing polymorphic sites are incubated with a 5'-fluorescein-labeled primer in the presence of allelic dye-labeled dideoxyribonucleoside triphosphates and a modified Taq polymerase. The dye-labeled primer is extended one base by the dye-terminator specific for the allele present on the template. At the end of the genotyping reaction, the fluorescence intensities of the two dyes in the reaction mixture are analyzed directly without separation or purification. All these steps can be performed in the same tube and the fluorescence changes can be monitored in real time. Alternatively, the extended primer may be analyzed by MALDI-TOF Mass Spectrometry. The base at the polymorphic site is identified by the mass added onto the microsequencing primer (see Haff L. A. and Smirnov I. P., *Genome Research,* 7:378–388, 1997), the disclosures of which are incorporated herein by reference in their entirety.

Microsequencing may be achieved by the established microsequencing method or by developments or derivatives thereof. Alternative methods include several solid-phase microsequencing techniques. The basic microsequencing protocol is the same as described previously, except that the method is conducted as a heterogenous phase assay, in which the primer or the target molecule is immobilized or captured onto a solid support. To simplify the primer separation and the terminal nucleotide addition analysis, oligonucleotides are attached to solid supports or are modified in such ways that permit affinity separation as well as polymerase extension. The 5' ends and internal nucleotides of synthetic oligonucleotides can be modified in a number of different ways to permit different affinity separation approaches, e.g., biotinylation. If a single affinity group is used on the oligonucleotides, the oligonucleotides can be separated from the incorporated terminator regent. This eliminates the need of physical or size separation. More than one oligonucleotide can be separated from the terminator reagent and analyzed simultaneously if more than one affinity group is used. This permits the analysis of several nucleic acid species or more nucleic acid sequence information per extension reaction. The affinity group need not be on the priming oligonucleotide but could alternatively be present on the template. For example, immobilization can be carried out via an interaction between biotinylated DNA and streptavidin-coated microtitration wells or avidin-coated polystyrene particles. In the same manner oligonucleotides or templates may be attached to a solid support in a high-density format. In such solid phase microsequencing reactions, incorporated ddNTPs can be radiolabeled (Syvänen, *Clinica Chimica Acta* 226:225–236, 1994) or linked to fluorescein (Livak and Hainer, *Human Mutation* 3:379–385,1994), the disclosures of which are incorporated herein by reference in their entirety. The detection of radiolabeled ddNTPs can be achieved through scintillation-based techniques. The detection of fluorescein-linked ddNTPs can be based on the binding of antifluorescein antibody conjugated with alkaline phosphatase, followed by incubation with a chromogenic substrate (such as p-nitrophenyl phosphate). Other possible reporter-detection pairs include: ddNTP linked to dinitrophenyl (DNP) and anti-DNP alkaline phosphatase conjugate (Harju et al., *Clin. Chem.* 39/11 2282–2287, 1993) or biotinylated ddNTP and horseradish peroxidase-conjugated streptavidin with o-phenylenediamine as a substrate (WO 92/15712), the disclosures of which are incorporated herein by reference in their entirety. As yet another alternative solid-phase microsequencing procedure, Nyren et al. (*Analytical Biochemistry* 208:171–175, 1993) described a method relying on the detection of DNA polymerase activity by an enzymatic luminometric inorganic pyrophosphate detection assay (ELIDA).

Pastinen et al. (*Genome research* 7:606–614, 1997), the disclosure of which is incorporated herein by reference in its entirety, describe a method for multiplex detection of single nucleotide polymorphism in which the solid phase minisequencing principle is applied to an oligonucleotide array format. High-density arrays of DNA probes attached to a solid support (DNA chips) are further described in IIIC.5.

In one aspect the present invention provides polynucleotides and methods to genotype one or more biallelic markers of the present invention by performing a microsequencing assay. Preferred microsequencing primers include those being featured Table 16. It will be appreciated that the microsequencing primers listed in Table 16 are merely exemplary and that, any primer having a 3' end immediately adjacent to a polymorphic nucleotide may be used. Similarly, it will be appreciated that microsequencing analysis may be performed for any biallelic marker or any combination of biallelic markers of the present invention. One aspect of the present invention is a solid support which includes one or more microsequencing primers listed in Table 16, or fragments comprising at least 8, at least 12, at least 15, or at least 20 consecutive nucleotides thereof and having a 3' terminus immediately upstream of the corresponding biallelic marker, for determining the identity of a nucleotide at biallelic marker site.

Mismatch Detection Assays Based on Polymerases and Ligases

In one aspect the present invention provides polynucleotides and methods to determine the allele of one or more biallelic markers of the present invention in a biological sample, by mismatch detection assays based on polymerases and/or ligases. These assays are based on the specificity of polymerases and ligases. Polymerization reactions places particularly stringent requirements on correct base pairing of the 3' end of the amplification primer and the joining of two oligonucleotides hybridized to a target DNA sequence is quite sensitive to mismatches close to the ligation site, especially at the 3' end. The terms "enzyme based mismatch detection assay" are used herein to refer to any method of determining the allele of a biallelic marker based on the specificity of ligases and polymerases. Preferred methods are described below. Methods, primers and various parameters to amplify DNA fragments comprising biallelic markers of the present invention are further described above in III.B.

Allele Specific Amplification

Discrimination between the two alleles of a biallelic marker can also be achieved by allele specific amplification, a selective strategy, whereby one of the alleles is amplified without amplification of the other allele. This is accomplished by placing a polymorphic base at the 3' end of one of the amplification primers. Because the extension forms from the 3' end of the primer, a mismatch at or near this position has an inhibitory effect on amplification. Therefore, under appropriate amplification conditions, these primers only direct amplification on their complementary allele. Designing the appropriate allele-specific primer and the corresponding assay conditions are well with the ordinary skill in the art.

Ligation Amplification Based Methods

The "Oligonucleotide Ligation Assay" (OLA) uses two oligonucleotides which are designed to be capable of hybridizing to abutting sequences of a single strand of a target molecules. One of the oligonucleotides is biotinylated, and the other is detectably labeled. If the precise complementary sequence is found in a target molecule, the oligonucleotides will hybridize such that their termini abut, and create a ligation substrate that can be captured and detected. OLA is capable of detecting biallelic markers and may be advantageously combined with PCR as described by Nickerson D. A. et al. (*Proc. Natl. Acad. Sci. U.S.A.* 87:8923–8927, 1990)., the disclosure of which is incorporated herein by reference in its entirety in this method, PCR is used to achieve the exponential amplification of target DNA, which is then detected using OLA.

Other methods which are particularly suited for the detection of biallelic markers include LCR (ligase chain reaction), Gap LCR (GLCR) which are described above in III.B. As mentioned above LCR uses two pairs of probes to exponentially amplify a specific target. The sequences of each pair of oligonucleotides, is selected to permit the pair to hybridize to abutting sequences of the same strand of the target. Such hybridization forms a substrate for a template-dependant ligase. In accordance with the present invention, LCR can be performed with oligonucleotides having the proximal and distal sequences of the same strand of a biallelic marker site. In one embodiment, either oligonucleotide will be designed to include the biallelic marker site. In such an embodiment, the reaction conditions are selected such that the oligonucleotides can be ligated together only if the target molecule either contains or lacks the specific nucleotide(s) that is complementary to the biallelic marker on the oligonucleotide. In an alternative embodiment, the oligonucleotides will not include the biallelic marker, such that when they hybridize to the target molecule, a "gap" is created as described in WO 90/01069, the disclosure of which is incorporated herein by reference in its entirety. This gap is then "filled" with complementary dNTPs (as mediated by DNA polymerase), or by an additional pair of oligonucleotides. Thus at the end of each cycle, each single strand has a complement capable of serving as a target during the next cycle and exponential allele-specific amplification of the desired sequence is obtained.

Ligase/Polymerase-mediated Genetic Bit Analysis™ is another method for determining the identity of a nucleotide at a preselected site in a nucleic acid molecule (WO 95/21271), the disclosure of which is incorporated herein by reference in its entirety. This method involves the incorporation of a nucleoside triphosphate that is complementary to the nucleotide present at the preselected site onto the terminus of a primer molecule, and their subsequent ligation to a second oligonucleotide. The reaction is monitored by detecting a specific label attached to the reaction's solid phase or by detection in solution.

Hybridization Assay Methods

A preferred method of determining the identity of the nucleotide present at a biallelic marker site involves nucleic acid hybridization. The hybridization probes, which can be conveniently used in such reactions, preferably include the probes defined herein. Any hybridization assay may be used including Southern hybridization, Northern hybridization, dot blot hybridization and solid-phase hybridization (see Sambrook et al., Molecular Cloning—A Laboratory Manual, Second Edition, Cold Spring Harbor Press, N.Y., 1989), the disclosure of which is incorporated herein by reference in its entirety.

Hybridization refers to the formation of a duplex structure by two single stranded nucleic acids due to complementary base pairing. Hybridization can occur between exactly complementary nucleic acid strands or between nucleic acid strands that contain minor regions of mismatch. Specific probes can be designed that hybridize to one form of a biallelic marker and not to the other and therefore are able to discriminate between different allelic forms. Allele-specific probes are often used in pairs, one member of a pair showing perfect match to a target sequence containing the original allele and the other showing a perfect match to the target sequence containing the alternative allele. Hybridization conditions should be sufficiently stringent that there is a significant difference in hybridization intensity between alleles, and preferably an essentially binary response, whereby a probe hybridizes to only one of the alleles. Stringent, sequence specific hybridization conditions, under which a probe will hybridize only to the exactly complementary target sequence are well known in the art (Sambrook et al., Molecular Cloning—A Laboratory Manual, Second Edition, Cold Spring Harbor Press, N.Y., 1989), the disclosures of which are incorporated herein by reference in their entirety. Stringent conditions are sequence dependent and will be different in different circumstances. Generally, stringent conditions are selected to be about 5° C. lower than the thermal melting point (Tm) for the specific sequence at a defined ionic strength and pH. By way of example and not limitation, procedures using conditions of high stringency are as follows: Prehybridization of filters containing DNA is carried out for 8 h to overnight at 65° C.

in buffer composed of 6×SSC, 50 mM Tris-HCl (pH 7.5), 1 mM EDTA, 0.02% PVP, 0.02% Ficoll, 0.02% BSA, and 500 μg/ml denatured salmon sperm DNA. Filters are hybridized for 48 h at 65° C., the preferred hybridization temperature, in prehybridization mixture containing 100 μg/ml denatured salmon sperm DNA and 5–20×10$^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. By way of example and not limitation, procedures using conditions of intermediate stringency are as follows: Filters containing DNA are prehybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of high and intermediate stringency which may be used are well known in the art and as cited in Sambrook et al. (Molecular Cloning—A Laboratory Manual, Second Edition, Cold Spring Harbor Press, N.Y., 1989) and Ausubel et al. (Current Protocols in Molecular Biology, Green Publishing Associates and Wiley Interscience, N.Y., 1989).

Although such hybridizations can be performed in solution, it is preferred to employ a solid-phase hybridization assay. The target DNA comprising a biallelic marker of the present invention may be amplified prior to the hybridization reaction. The presence of a specific allele in the sample is determined by detecting the presence or the absence of stable hybrid duplexes formed between the probe and the target DNA. The detection of hybrid duplexes can be carried out by a number of methods. Various detection assay formats are well known which utilize detectable labels bound to either the target or the probe to enable detection of the hybrid duplexes. Typically, hybridization duplexes are separated from unhybridized nucleic acids and the labels bound to the duplexes are then detected. Those skilled in the art will recognize that wash steps may be employed to wash away excess target DNA or probe. Standard heterogeneous assay formats are suitable for detecting the hybrids using the labels present on the primers and probes.

Two recently developed assays allow hybridization-based allele discrimination with no need for separations or washes (see Landegren U. et al., *Genome Research*, 8:769–776, 1998), the disclosure of which is incorporated herein by reference in its entirety. The TaqMan assay takes advantage of the 5' nuclease activity of Taq DNA polymerase to digest a DNA probe annealed specifically to the accumulating amplification product. TaqMan probes are labeled with a donor-acceptor dye pair that interacts via fluorescence energy transfer. Cleavage of the TaqMan probe by the advancing polymerase during amplification dissociates the donor dye from the quenching acceptor dye, greatly increasing the donor fluorescence. All reagents necessary to detect two allelic variants can be assembled at the beginning of the reaction and the results are monitored in real time (see Livak et al., *Nature Genetics*, 9:341–342, 1995), the disclosure of which is incorporated herein by reference in its entirety. In an alternative homogeneous hybridization-based procedure, molecular beacons are used for allele discriminations.

Molecular beacons are hairpin-shaped oligonucleotide probes that report the presence of specific nucleic acids in homogeneous solutions. When they bind to their targets they undergo a conformational reorganization that restores the fluorescence of an internally quenched fluorophore (Tyagi et al., *Nature Biotechnology*, 16:49–53, 1998)., the disclosure of which is incorporated herein by reference in its entirety The polynucleotides provided herein can be used in hybridization assays for the detection of biallelic marker alleles in biological samples. These probes are characterized in that they preferably comprise between 8 and 50 nucleotides, and in that they are sufficiently complementary to a sequence comprising a biallelic marker of the present invention to hybridize thereto and preferably sufficiently specific to be able to discriminate the targeted sequence for only one nucleotide variation. The GC content in the probes of the invention usually ranges between 10 and 75%, preferably between 35 and 60%, and more preferably between 40 and 55%. The length of these probes can range from 10, 15, 20, or 30 to at least 100 nucleotides, preferably from 10 to 50, more preferably from 18 to 35 nucleotides. A particularly preferred probe is 25 nucleotides in length. Preferably the biallelic marker is within 4 nucleotides of the center of the polynucleotide probe. In particularly preferred probes the biallelic marker is at the center of said polynucleotide. Shorter probes may lack specificity for a target nucleic acid sequence and generally require cooler temperatures to form sufficiently stable hybrid complexes with the template. Longer probes are expensive to produce and can sometimes self-hybridize to form hairpin structures. Methods for the synthesis of oligonucleotide probes have been described above and can be applied to the probes of the present invention.

Preferably the probes of the present invention are labeled or immobilized on a solid support. Labels and solid supports are further described in I. Detection probes are generally nucleic acid sequences or uncharged nucleic acid analogs such as, for example peptide nucleic acids which are disclosed in International Patent Application WO 92/20702, d, morpholino analogs which are described in U.S. Pat. Nos. 5,185,444; 5,034,506 and 5,142,047, the disclosures of which are incorporated herein by reference in their entirety. The probe may have to be rendered "non-extendable" in that additional dNTPs cannot be added to the probe. In and of themselves analogs usually are non-extendable and nucleic acid probes can be rendered non-extendable by modifying the 3' end of the probe such that the hydroxyl group is no longer capable of participating in elongation. For example, the 3' end of the probe can be functionalized with the capture or detection label to thereby consume or otherwise block the hydroxyl group. Alternatively, the 3' hydroxyl group simply can be cleaved, replaced or modified, U.S. patent application Ser. No. 07/049,061 filed Apr. 19, 1993 describes modifications, which can be used to render a probe non-extendable.

The probes of the present invention are useful for a number of purposes. They can be used in Southern hybridization to genomic DNA or Northern hybridization to mRNA. The probes can also be used to detect PCR amplification products. By assaying the hybridization to an allele specific probe, one can detect the presence or absence of a biallelic marker allele in a given sample.

High-Throughput parallel hybridizations in array format are specifically encompassed within "hybridization assays" and are described below.

Hybridization to Addressable Arrays of Oligonucleotides

Hybridization assays based on oligonucleotide arrays rely on the differences in hybridization stability of short oligonucleotides to perfectly matched and mismatched target sequence variants. Efficient access to polymorphism information is obtained through a basic structure comprising high-density arrays of oligonucleotide probes attached to a solid support (the chip) at selected positions. Each DNA chip can contain thousands to millions of individual synthetic DNA probes arranged in a grid-ike pattern and miniaturized to the size of a dime.

The chip technology has already been applied with success in numerous cases. For example, the screening of mutations has been undertaken in the BRCA1 gene, in *S. cerevisiae* mutant strains, and in the protease gene of HIV-1 virus (Hacia et al., *Nature Genetics*, 14(4):441–447, 1996; Shoemaker et al., *Nature Genetics*, 14(4):450–456, 1996 ; Kozal et al., *Nature Medicine*, 2:753–759, 1996)the disclosures of which are incorporated herein by reference in their entirety. Chips of various formats for use in detecting biallelic polymorphisms can be produced on a customized basis by Affymetrix (GeneChip™), Hyseq (HyChip and HyGnostics), and Protogene Laboratories.

In general, these methods employ arrays of oligonucleotide probes that are complementary to target nucleic acid sequence segments from an individual which, target sequences include a polymorphic marker. EP785280, the disclosure of which is incorporated herein by reference in its entirety, describes a tiling strategy for the detection of single nucleotide polymorphisms. Briefly, arrays may generally be "tiled" for a large number of specific polymorphisms. By "tiling" is generally meant the synthesis of a defined set of oligonucleotide probes which is made up of a sequence complementary to the target sequence of interest, as well as preselected variations of that sequence, e.g., substitution of one or more given positions with one or more members of the basis set of monomers, i.e. nucleotides. Tiling strategies are further described in PCT application No. WO 95/11995, the disclosure of which is incorporated herein by reference in its entirety. In a particular aspect, arrays are tiled for a number of specific, identified biallelic marker sequences. In particular the array is tiled to include a number of detection blocks, each detection block being specific for a specific biallelic marker or a set of biallelic markers. For example, a detection block may be tiled to include a number of probes, which span the sequence segment that includes a specific polymorphism. To ensure probes that are complementary to each allele, the probes are synthesized in pairs differing at the biallelic marker. In addition to the probes differing at the polymorphic base, monosubstituted probes are also generally tiled within the detection block. These monosubstituted probes have bases at and up to a certain number of bases in either direction from the polymorphism, substituted with the remaining nucleotides (selected from A, T, G, C and U). Typically the probes in a tiled detection block will include substitutions of the sequence positions up to and including those that are 5 bases away from the biallelic marker. The monosubstituted probes provide internal controls for the tiled array, to distinguish actual hybridization from artefactual cross-hybridization. Upon completion of hybridization with the target sequence and washing of the array, the array is scanned to determine the position on the array to which the target sequence hybridizes. The hybridization data from the scanned array is then analyzed to identify which allele or alleles of the biallelic marker are present in the sample. Hybridization and scanning may be carried out as described in PCT application No. WO 92/10092 and WO 95/11995 and U.S. Pat. No. 5,424,186, the disclosures of which are incorporated herein by reference in their entirety.

Thus, in some embodiments, the chips may comprise an array of nucleic acid sequences of fragments of about 15 nucleotides in length. In further embodiments, the chip may comprise an array including at least one of the sequences selected from the group consisting of SEQ ID No. 1–38, 40–54, 56–463, 465–487, 490–493 and the sequences complementary thereto; preferably SEQ ID Nos. 485–487, 494–531, 533–547, 549–846, 848–956, 958–977 and the sequences complementary thereto; or a fragment thereof at least about 8 consecutive nucleotides, preferably 10, 15, 20, more preferably 25, 30, 40, 47, or 50 consecutive nucleotides. In some embodiments, the chip may comprise an array of at least 2, 3, 4, 5, 6, 7, 8 or more of these polynucleotides of the invention. Solid supports and polynucleotides of the present invention attached to solid supports are further described in I. "Biallelic Markers and Polynucleotides Comprising Biallelic Markers."

Integrated Systems

Another technique, which may be used to analyze polymorphisms, includes multicomponent integrated systems, which miniaturize and compartmentalize processes such as PCR and capillary electrophoresis reactions in a single functional device. An example of such technique is disclosed in U.S. Pat. No. 5,589,136, the disclosure of which is incorporated herein by reference in its entirety, which describes the integration of PCR amplification and capillary electrophoresis in chips.

Integrated systems can be envisaged mainly when microfluidic systems are used. These systems comprise a pattern of microchannels designed onto a glass, silicon, quartz, or plastic wafer included on a microchip. The movements of the samples are controlled by electric, electroosmotic or hydrostatic forces applied across different areas of the microchip. For genotyping biallelic markers, the microfluidic system may integrate nucleic acid amplification, microsequencing, capillary electrophoresis and a detection method such as laser-induced fluorescence detection.

IV. Methods of Genetic Analysis Using the Biallelic Markers of the Present Invention Different methods are available for the genetic analysis of complex traits (see Lander and Schork, *Science*, 265, 2037–2048, 1994), the disclosure of which is incorporated herein by reference in its entirety. The search for disease-susceptibility genes is conducted using two main methods: the linkage approach in which evidence is sought for cosegregation between a locus and a putative trait locus using family studies, and the association approach in which evidence is sought for a statistically significant association between an allele and a trait or a trait causing allele (Khoury J. et al., *Fundamentals of Genetic Epidemiology*, Oxford University Press, NY, 1993), the disclosure of which is incorporated herein by reference in its entirety. In general, the biallelic markers of the present invention find use in any method known in the art to demonstrate a statistically significant correlation between a genotype and a phenotype. The biallelic markers may be used in parametric and non-parametric linkage analysis methods. Preferably, the biallelic markers of the present invention are used to identify genes associated with detectable traits using association studies, an approach which does not require the use of affected families and which permits the identification of genes associated with complex and sporadic traits.

The genetic analysis using the biallelic markers of the present invention may be conducted on any scale. The whole set of biallelic markers of the present invention or any subset of biallelic markers of the present invention may be used. In some embodiments a subset of biallelic markers corresponding to one or several candidate genes of the present invention may be used. In other embodiments a subset of biallelic markers corresponding to candidate genes from a given metabolic pathway may be used. Such pathways include glucoronidation and glutathione conjugation. Alternatively, a subset of biallelic markers of the present invention localised on a specific chromosome segment may be used. Further, any set of genetic markers including a biallelic marker of the present invention may be used. A set of biallelic polymorphisms that, could be used as genetic markers in combination with the biallelic markers of the present invention, has been described in WO 98/20165, the disclosure of which is incorporated herein by reference in its entirety. As mentioned above, the biallelic markers of the present invention may be included in any complete or partial genetic map of the human genome. These different uses are specifically contemplated in the present invention and claims.

A. Linkage Analysis

Linkage analysis is based upon establishing a correlation between the transmission of genetic markers and that of a specific trait throughout generations within a family. Thus, the aim of linkage analysis is to detect marker loci that show cosegregation with a trait of interest in pedigrees.

Parametric Methods

When data are available from successive generations there is the opportunity to study the degree of linkage between pairs of loci. Estimates of the recombination fraction enable loci to be ordered and placed onto a genetic map. With loci that are genetic markers, a genetic map can be established, and then the strength of linkage between markers and traits can be calculated and used to indicate the relative positions of markers and genes affecting those traits (Weir, B. S., *Genetic data Analysis II: Methods for Discrete population genetic Data, Sinauer Assoc., Inc., Sunderland, Mass., USA,* 1996), the disclosure of which is incorporated herein by reference in its entirety. The classical method for linkage analysis is the logarithm of odds (lod) score method (see Morton N. E., *Am.J. Hum. Genet.,* 7:277–318, 1955; Ott J., *Analysis of Human Genetic Linkage, John Hopkins University Press, Baltimore,* 1991), the disclosures of which are incorporated herein by reference in their entirety. Calculation of lod scores requires specification of the mode of inheritance for the disease (parametric method). Generally, the length of the candidate region identified using linkage analysis is between 2 and 20 Mb. Once a candidate region is identified as described above, analysis of recombinant individuals using additional markers allows further delineation of the candidate region. Linkage analysis studies have generally relied on the use of a maximum of 5,000 microsatellite markers, thus limiting the maximum theoretical attainable resolution of linkage analysis to about 600 kb on average.

Linkage analysis has been successfully applied to map simple genetic traits that show clear Mendelian inheritance patterns and have a high penetrance (i.e., the ratio between the number of trait positive carriers of allele a and the total number of a carriers in the population). However, parametric linkage analysis suffers from a variety of drawbacks. First, it is limited by its reliance on the choice of a genetic model suitable for each studied trait. Furthermore, as already mentioned, the resolution attainable using linkage analysis is limited, and complementary studies are required to refine the analysis of the typical 2 Mb to 20 Mb regions initially identified through linkage analysis. In addition, parametric linkage analysis approaches have proven difficult when applied to complex genetic traits, such as those due to the combined action of multiple genes and/or environmental factors. It is very difficult to model these factors adequately in a lod score analysis. In such cases, too large an effort and cost are needed to recruit the adequate number of affected families required for applying linkage analysis to these situations, as recently discussed by Risch, N. and Merikangas, K. (*Science,* 273:1516–1517, 1996), the disclosure of which is incorporated herein by reference in its entirety.

Non-parametric Methods

The advantage of the so-called non-parametric methods for linkage analysis is that they do not require specification of the mode of inheritance for the disease, they tend to be more useful for the analysis of complex traits. In non-parametric methods, one tries to prove that the inheritance pattern of a chromosomal region is not consistent with random Mendelian segregation by showing that affected relatives inherit identical copies of the region more often than expected by chance. Affected relatives should show excess "allele sharing" even in the presence of incomplete penetrance and polygenic inheritance. In non-parametric linkage analysis the degree of agreement at a marker locus in two individuals can be measured either by the number of alleles identical by state (IBS) or by the number of alleles identical by descent (IBD). Affected sib pair analysis is a well-known special case and is the simplest form of these methods.

The biallelic markers of the present invention may be used in both parametric and non-parametric linkage analysis. Preferably biallelic markers may be used in non-parametric methods which allow the mapping of genes involved in complex traits. The biallelic markers of the present invention may be used in both IBD- and IBS-methods to map genes affecting a complex trait. In such studies, taking advantage of the high density of biallelic markers, several adjacent biallelic marker loci may be pooled to achieve the efficiency attained by multi-allelic markers (Zhao et al., *Am. J. Hum. Genet.,* 63:225–240, 1998), the disclosure of which is incorporated herein by reference in its entirety.

However, both parametric and non-parametric linkage analysis methods analyse affected relatives, they tend to be of limited value in the genetic analysis of drug responses or in the analysis of side effects to treatments. This type of analysis is impractical in such cases due to the lack of availability of familial cases. In fact, the likelihood of having more than one individual in a family being exposed to the same drug at the same time is extremely low.

B. Population Association Studies

The present invention comprises methods for identifying one or several genes among a set of candidate genes that are associated with a detectable trait using the biallelic markers of the present invention. In one embodiment the present invention comprises methods to detect an association between a biallelic marker allele or a biallelic marker haplotype and a trait. Further, the invention comprises methods to identify a trait causing allele in linkage disequilibrium with any biallelic marker allele of the present invention.

As described above, alternative approaches can be employed to perform association studies: genome-wide association studies, candidate region association studies and candidate gene association studies. In a preferred embodiment, the biallelic markers of the present invention are used to perform candidate gene association studies. The candidate gene analysis clearly provides a short-cut approach to the identification of genes and gene polymorphisms related to a particular trait when some information concerning the biology of the trait is available. Further, the biallelic markers of the present invention may be incorporated in any map of genetic markers of the human genome in order to perform genome-wide association studies. Methods to generate a high-density map of biallelic markers has been described in U.S. Provisional Patent application serial No. 60/082,614. The biallelic markers of the present invention may further be incorporated in any map of a specific candidate region of the genome (a specific chromosome or a specific chromosomal segment for example).

As mentioned above, association studies may be conducted within the general population and are not limited to studies performed on related individuals in affected families. Association studies are extremely valuable as they permit the analysis of sporadic or multifactor traits. Moreover, association studies represent a powerful method for fine-scale mapping enabling much finer mapping of trait causing alleles than linkage studies. Studies based on pedigrees often only narrow the location of the trait causing allele. Association studies using the biallelic markers of the present invention can therefore be used to refine the location of a trait causing allele in a candidate region identified by Linkage Analysis methods. Moreover, once a chromosome segment of interest has been identified, the presence of a candidate gene such as a candidate gene of the present invention, in the region of interest can provide a shortcut to the identification of the trait causing allele. Biallelic markers of the present invention can be used to demonstrate that a candidate gene is associated with a trait. Such uses are specifically contemplated in the present invention and claims.

Determining the Frequency of a Biallelic Marker Allele or of a Biallelic Marker Haplotype in a Population Association studies explore the relationships among frequencies for sets of alleles between loci.

Determining the Frequency of an Allele in a Population

Allelic frequencies of the biallelic markers in a population can be determined using one of the methods described above under the heading "Methods for genotyping an individual for biallelic markers", or any genotyping procedure suitable for this intended purpose. Genotyping pooled samples or individual samples can determine the frequency of a biallelic marker allele in a population. One way to reduce the number of genotypings required is to use pooled samples. A major obstacle in using pooled samples is in terms of accuracy and reproducibility for determining accurate DNA concentrations in setting up the pools. Genotyping individual samples provides higher sensitivity, reproducibility and accuracy and; is the preferred method used in the present invention. Preferably, each individual is genotyped separately and simple gene counting is applied to determine the frequency of an allele of a biallelic marker or of a genotype in a given population.

Determining the Frequency of a Haplotype in a Population

The gametic phase of haplotypes is unknown when diploid individuals are heterozygous at more than one locus. Using genealogical information in families gametic phase can sometimes be inferred (Perlin et al., *Am. J. Hum. Genet.*, 55:777–787, 1994), the disclosure of which is incorporated herein by reference in its entirety. When no genealogical information is available different strategies may be used. One possibility is that the multiple-site heterozygous diploids can be eliminated from the analysis, keeping only the homozygotes and the single-site heterozygote individuals, but this approach might lead to a possible bias in the sample composition and the underestimation of low-frequency haplotypes. Another possibility is that single chromosomes can be studied independently, for example, by asymmetric PCR amplification (see Newton et al., *Nucleic Acids Res.*, 17:2503–2516, 1989; Wu et al., *Proc. Natl. Acad. Sci. USA*, 86:2757, 1989), the disclosures of which are incorporated herein by reference in their entirety, or by isolation of single chromosome by limit dilution followed by PCR amplification (see Ruano et al., *Proc. Natl. Acad. Sci. USA*, 87:6296–6300, 1990), the disclosure of which is incorporated herein by reference in its entirety. Further, a sample may be haplotyped for sufficiently close biallelic markers by double PCR amplification of specific alleles (Sarkar, G. and Sommer S. S., *Biotechniques*, 1991), the disclosure of which is incorporated herein by reference in its entirety. These approaches are not entirely satisfying either because of their technical complexity, the additional cost they entail, their lack of generalisation at a large scale, or the possible biases they introduce. To overcome these difficulties, an algorithm to infer the phase of PCR-amplified DNA genotypes introduced by Clark A. G. (*Mol. Biol. Evol.*, 7:111–122, 1990), the disclosure of which is incorporated herein by reference in its entirety, may be used. Briefly, the principle is to start filling a preliminary list of haplotypes present in the sample by examining unambiguous individuals, that is, the complete homozygotes and the single-site heterozygotes. Then other individuals in the same sample are screened for the possible occurrence of previously recognised haplotypes. For each positive identification, the complementary haplotype is added to the list of recognised haplotypes, until the phase information for all individuals is either resolved or identified as unresolved. This method assigns a single haplotype to each multiheterozygous individual, whereas several haplotypes are possible when there are more than one heterozygous site. Alternatively, one can use methods estimating haplotype frequencies in a population without assigning haplotypes to each individual. Preferably, a method based on an expectation-maximization (EM) algorithm (Dempster et al., *J. R. Stat. Soc.*, 39B: 1–38, 1977), the disclosure of which is incorporated herein by reference in its entirety, leading to maximum-likelihood estimates of haplotype frequencies under the assumption of Hardy-Weinberg proportions (random mating) is used (see Excoffier L. and Slatkin M., *Mol. Biol. Evol.*, 12(5): 921–927, 1995), the disclosure of which is incorporated herein by reference in its entirety. The EM algorithm is a generalised iterative maximum-likelihood approach to estimation that is useful when data are ambiguous and/or incomplete. The EM algorithm is used to resolve heterozygotes into haplotypes. Haplotype estimations are further described below under the heading "Statistical methods." Any other method known in the art to determine or to estimate the frequency of a haplotype in a population may also be used.

Linkage Disequilibrium Analysis

Linkage disequilibrium is the non-random association of alleles at two or more loci and represents a powerful tool for mapping genes involved in disease traits (see Ajioka R. S. et al., *Am. J. Hum. Genet.*, 60:1439–1447, 1997), the disclosure of which is incorporated herein by reference in its entirety. Biallelic markers, because they are densely spaced in the human genome and can be genotyped in more numerous numbers than other types of genetic markers (such as RFLP or VNTR markers), are particularly useful in genetic analysis based on linkage disequilibrium. The biallelic markers of the present invention may be used in any linkage disequilibrium analysis method known in the art.

Briefly, when a disease mutation is first introduced into a population (by a new mutation or the immigration of a mutation carrier), it necessarily resides on a single chromosome and thus on a single "background" or "ancestral"

haplotype of linked markers. Consequently, there is complete disequilibrium between these markers and the disease mutation: one finds the disease mutation only in the presence of a specific set of marker alleles. Through subsequent generations recombinations occur between the disease mutation and these marker polymorphisms, and the disequilibrium gradually dissipates. The pace of this dissipation is a function of the recombination frequency, so the markers closest to the disease gene will manifest higher levels of disequilibrium than those that are further away. When not broken up by recombination, "ancestral" haplotypes and linkage disequilibrium between marker alleles at different loci can be tracked not only through pedigrees but also through populations. Linkage disequilibrium is usually seen as an association between one specific allele at one locus and another specific allele at a second locus.

The pattern or curve of disequilibrium between disease and marker loci is expected to exhibit a maximum that occurs at the disease locus. Consequently, the amount of linkage disequilibrium between a disease allele and closely linked genetic markers may yield valuable information regarding the location of the disease gene. For fine-scale mapping of a disease locus, it is useful to have some knowledge of the patterns of linkage disequilibrium that exist between markers in the studied region. As mentioned above the mapping resolution achieved through the analysis of linkage disequilibrium is much higher than that of linkage studies. The high density of biallelic markers combined with linkage disequilibrium analysis provides powerful tools for fine-scale mapping. Different methods to calculate linkage disequilibrium are described below under the heading "Statistical Methods."

Population-Based Case-Control Studies of Trait-Marker Associations

As mentioned above, the occurrence of pairs of specific alleles at different loci on the same chromosome is not random and the deviation from random is called linkage disequilibrium. Association studies focus on population frequencies and rely on the phenomenon of linkage disequilibrium. If a specific allele in a given gene is directly involved in causing a particular trait, its frequency will be statistically increased in an affected (trait positive) population, when compared to the frequency in a trait negative population or in a random control population. As a consequence of the existence of linkage disequilibrium, the frequency of all other alleles present in the haplotype carrying the trait-causing allele will also be increased in trait positive individuals compared to trait negative individuals or random controls. Therefore, association between the trait and any allele (specifically a biallelic marker allele) in linkage disequilibrium with the trait-causing allele will suffice to suggest the presence of a trait-related gene in that particular region. Case-control populations can be genotyped for biallelic markers to identify associations that narrowly locate a trait causing allele. As any marker in linkage disequilibrium with one given marker associated with a trait will be associated with the trait. Linkage disequilibrium allows the relative frequencies in case-control populations of a limited number of genetic polymorphisms (specifically biallelic markers) to be analysed as an alternative to screening all possible functional polymorphisms in order to find trait-causing alleles. Association studies compare the frequency of marker alleles in unrelated case-control populations, and represent powerful tools for the dissection of complex traits.

Case-Control Populations (Inclusion Criteria)

Population-based association studies do not concern familial inheritance but compare the prevalence of a particular genetic marker, or a set of markers, in case-control populations. They are case-control studies based on comparison of unrelated case (affected or trait positive) individuals and unrelated control (unaffected or trait negative or random) individuals. Preferably the control group is composed of unaffected or trait negative individuals. Further, the control group is ethnically matched to the case population. Moreover, the control group is preferably matched to the case-population for the main known confusion factor for the trait under study (for example age-matched for an age-dependent trait). Ideally, individuals in the two samples are paired in such a way that they are expected to differ only in their disease status. In the following "trait positive population", "case population" and "affected population" are used interchangeably.

An important step in the dissection of complex traits using association studies is the choice of case-control populations (see Lander and Schork *Science,* 265, 2037–2048, 1994), the disclosure of which is incorporated herein by reference in its entirety. A major step in the choice of case-control populations is the clinical definition of a given trait or phenotype. Any genetic trait may be analysed by the association method proposed here by carefully selecting the individuals to be included in the trait positive and trait negative phenotypic groups. Four criteria are often useful: clinical phenotype, age at onset, family history and severity. The selection procedure for continuous or quantitative traits (such as blood pressure for example) involves selecting individuals at opposite ends of the phenotype distribution of the trait under study, so as to include in these trait positive and trait negative populations individuals with non-overlapping phenotypes. Preferably, case-control populations consist of phenotypically homogeneous populations. Trait positive and trait negative populations consist of phenotypically uniform populations of individuals representing each between 1 and 98%, preferably between 1 and 80%, more preferably between 1 and 50%, and more preferably between 1 and 30%, most preferably between 1 and 20% of the total population under study, and selected among individuals exhibiting non-overlapping phenotypes. The clearer the difference between the two trait phenotypes, the greater the probability of detecting an association with biallelic markers. The selection of those drastically different but relatively uniform phenotypes enables efficient comparisons in association studies and the possible detection of marked differences at the genetic level, provided that the sample sizes of the populations under study are significant enough.

In preferred embodiments, a first group of between 50 and 300 trait positive individuals, preferably about 100 individuals, are recruited according to their phenotypes. A similar number of trait negative individuals are included in such studies.

In the present invention, typical examples of inclusion criteria include a disease involving the metabolic conversion of xenobiotics or the evaluation of the response to a drug or side effects to treatment with drugs.

Suitable examples of association studies using biallelic markers including the biallelic markers of the present invention, are studies involving the following populations:

a case population suffering from a disease involving the metabolic conversion of xenobiotics and a healthy unaffected control population, or a case population treated with therapeutic agents suffering from side-effects resulting from the treatment and a control population treated with the same agents showing no side-effects, or a case population treated with therapeutic agents showing a beneficial response and a control population treated with same agents showing no beneficial response.

In a preferred embodiment, the trait considered was a side-effect upon drug treatment, the study involved two populations derived from a clinical study of the anti-asthmatic drug zileuton. The case population was composed of asthmatic individuals treated with zileuton showing zileuton-associated hepatotoxicity monitored by the serum level of alanine aminotransferase (ALT) and the control population was composed of asthmatic individuals treated with zileuton and having no increased serum level of ALT. Inclusion criteria and association between the biallelic markers of the present invention and zileuton-associated hepatotoxicity are further described below and in Example 4.

Association Analysis

The general strategy to perform association studies using biallelic markers derived from a region carrying a candidate gene is to scan two groups of individuals (case-control populations) in order to measure and statistically compare the allele frequencies of the biallelic markers of the present invention in both groups.

If a statistically significant association with a trait is identified for at least one or more of the analysed biallelic markers, one can assume that: either the associated allele is directly responsible for causing the trait (the associated allele is the trait causing allele), or more likely the associated allele is in linkage disequilibrium with the trait causing allele. The specific characteristics of the associated allele with respect to the candidate gene function usually gives further insight into the relationship between the associated allele and the trait (causal or in linkage disequilibrium). If the evidence indicates that the associated allele within the candidate gene is most probably not the trait causing allele but is in linkage disequilibrium with the real trait causing allele, then the trait causing allele can be found by sequencing the vicinity of the associated marker.

Association studies are usually run in two successive steps. In a first phase, the frequencies of a reduced number of biallelic markers from one or several candidate genes are determined in the trait positive and trait negative populations. hi a second phase of the analysis, the identity of the candidate gene and the position of the genetic loci responsible for the given trait is further refined using a higher density of markers from the relevant region. However, if the candidate gene under study is relatively small in length, as it is the case for many of the candidate genes analysed included in the present invention, a single phase may be sufficient to establish significant associations.

Haplotype Analysis

As described above, when a chromosome carrying a disease allele first appears in a population as a result of either mutation or migration, the mutant allele necessarily resides on a chromosome having a set of linked markers: the ancestral haplotype. This haplotype can be tracked through populations and its statistical association with a given trait can be analysed. Complementing single point (allelic) association studies with multi-point association studies also called haplotype studies increases the statistical power of association studies. Thus, a haplotype association study allows one to define the frequency and the type of the ancestral carrier haplotype. A haplotype analysis is important in that it increases the statistical power of an analysis involving individual markers.

In a first stage of a haplotype frequency analysis, the frequency of the possible haplotypes based on various combinations of the identified biallelic markers of the invention is determined. The haplotype frequency is then compared for distinct populations of trait positive and control individuals. The number of trait positive individuals, which should be, subjected to this analysis to obtain statistically significant results usually ranges between 30 and 300, with a preferred number of individuals ranging between 50 and 150. The same considerations apply to the number of unaffected individuals (or random control) used in the study. The results of this first analysis provide haplotype frequencies in case-control populations, for each evaluated haplotype frequency a p-value and an odd ratio are calculated. If a statistically significant association is found, the relative risk for an individual carrying the given haplotype of being affected with the trait under study can be approximated.

The preferred 2, 3 and 4 marker haplotypes of the invention are listed in Table 4 below:

TABLE 4

| GENE | MARKER 1 | MARKER 2 | MARKER 3 | MARKER 4 |
|---|---|---|---|---|
| MGST-II | 12-455-326 | 12-453-429 | 12-424-198 | |
| MGST-II | 12-455-326 | 12-453-429 | 12-424-198 | 12-454-363 |
| MGST-II | 12-447-58 | 12-455-326 | 12-461-299 | 12-453-429 |
| MGST-II | 12-441-233 | 12-461-299 | 12-453-429 | |
| MGST-II | 12-441-233 | 12-461-299 | 12-453-429 | 12-426-154 |
| MGST-II | 12-426-154 | 12-424-198 | | |
| MGST-II | 12-426-154 | 12-461-299 | 12-424-198 | |
| MEI | 10-428-219 | 12-724-225 | | |
| UGT1A7 | 12-128-225 | 12-156-91 | 12-139-380 | 12-140-134 |
| UGT1A7 | 12-148-311 | 12-156-91 | 12-139-380 | 12-140-134 |
| UGT2B4 | 10-470-25 | 12-652-203 | | |
| UGT2B4 | 10-470-25 | 12-637-219 | 12-652-203 | |

The most preferred 2, 3 and 4 marker haplotypes of the invention are listed in Table 5 below:

TABLE 5

| GENE | MARKER 1 | MARKER 2 | MARKER 3 | MARKER 4 |
|---|---|---|---|---|
| M6ST-II | 12-455-326 | 12-453-429 | 12-424-198 | |
| MGST-II | 12-455-326 | 12-453-429 | 12-424-198 | 12-454-363 |
| M6ST-II | 12-447-58 | 12-455-326 | 12-461-299 | 12-453-429 |
| MGST-II | 12-426-154 | 12-424-198 | | |
| ME1 | 10-428-219 | 12-724-225 | | |
| UGT1A7 | 12-128-225 | 12-156-91 | 12-139-380 | 12-140-134 |
| UGT2B4 | 10-470-25 | 12-652-203 | | |

Interaction Analysis

The biallelic markers of the present invention may also be used to identify patterns of biallelic markers associated with detectable traits resulting from polygenic interactions. The analysis of genetic interaction between alleles at unlinked loci requires individual genotyping using the techniques described herein. The analysis of allelic interaction among a selected set of biallelic markers with appropriate level of statistical significance can be considered as a haplotype analysis. Interaction analysis consists in stratifying the case-control populations with respect to a given haplotype for the first loci and performing a haplotype analysis with the second loci with each subpopulation.

Statistical methods used in association studies are further described below in "Statistical Methods."

Testing for Linkage in the Presence of Association

The biallelic markers of the present invention may further be used in TDT (transmission/disequilibrium test). TDT tests for both linkage and association and is not affected by population stratification. TDT requires data for affected individuals and their parents or data from unaffected sibs instead of from parents (see Spielmann S. et al., Am. J. Hum. Genet., 52:506–516, 1993; Schaid D. J. et al., Genet. Epidemiol.,13:423–450, 1996, Spielmann S. and Ewens W. J., Am. J. Hum. Genet., 62:450–458, 1998), the disclosures of which are incorporated herein by reference in their entirety. Such combined tests generally reduce the false-positive errors produced by separate analyses.

C. Statistical Methods

In general, any method known in the art to test whether a trait and a genotype show a statistically significant correlation may be used.

Methods in Linkage Analysis

Statistical methods and computer programs useful for linkage analysis are well known to those skilled in the art (see Terwilliger J. D. and Ott J., *Handbook of Human Genetic Linkage*, John Hopkins University Press, London, 1994; Ott J., *Analysis of Human Genetic Linkage*, John Hopkins University Press, Baltimore, 1991), the disclosures of which are incorporated herein by reference in their entirety.

Methods to Estimate Haplotype Frequencies in a Population

As described above, when genotypes are scored, it is often not possible to distinguish heterozygotes so that haplotype frequencies cannot be easily inferred. When the gametic phase is not known, haplotype frequencies can be estimated from the multilocus genotypic data. Any method known to person skilled in the art can be used to estimate haplotype frequencies (see Lange K., *Mathematical and Statistical Methods for Genetic Analysis*, Springer, N.Y., 1997; Weir, B. S., *Genetic data Analysis II: Methods for Discrete population genetic Data*, Sinauer Assoc., Inc., Sunderland, Mass., USA, 1996), the disclosures of which are incorporated herein by reference in their entirety. Preferably, maximum-likelihood haplotype frequencies are computed using an Expectation-Maximization (EM) algorithm (see Dempster et al., *J. R. Stat. Soc.*, 39B: 1–38, 1977; Excoffier L. and Slatkin M., *Mol. Biol. Evol.*, 12(5): 921–927, 1995)., the disclosures of which are incorporated herein by reference in their entirety. This procedure is an iterative process aiming at obtaining maximum-likelihood estimates of haplotype frequencies from multi-locus genotype data when the gametic phase is unknown. Haplotype estimations are usually performed by applying the EM algorithm using, for example, the EM-HAPLO program (Hawley M. E. et al., *Am. J. Phys. Anthropol.*, 18:104,1994) or the Arlequin program (Schneider et al., *Arlequin: a software for population genetics data analysis*, University of Geneva, 1997), the disclosure of which is incorporated herein by reference in its entirety. The EM algorithm is a generalised iterative maximum likelihood approach to estimation and is briefly described below.

In what follows, phenotypes will refer to multi-locus genotypes with unknown haplotypic phase. Genotypes will refer to mutli-locus genotypes with known haplotypic phase.

Suppose one has a sample of N unrelated individuals typed for K markers. The data observed are the unknown-phase K-locus phenotypes that can be categorized with F different phenotypes. Further, suppose that we have H possible haplotypes (in the case of K biallelic markers, we have for the maximum number of possible haplotypes $H=2^K$). For phenotype j with $c_j$ possible genotypes, we have:

$$P_j = \sum_{i=1}^{c_j} P(genotype(i)) = \sum_{i=1}^{c_j} P(h_k, h_l). \qquad \text{Equation 1}$$

Here, $P_j$ is the probability of the $j^{th}$ phenotype, and $P(h_k, h_l)$ is the probability of the $i^{th}$ genotype composed of haplotypes $h_k$ and $h_l$. Under random mating (i.e. Hardy-Weinberg Equilibrium), $P(h_k, h_l)$ is expressed as:

$$P(h_k, h_l) = P(h_k)^2 \text{ for } h_k = h_l,$$

and $$P(h_k, h_l) = 2P(h_k)P(h_l) \text{ for } h_k \neq h_l. \qquad \text{Equation 2}$$

The E-M algorithm is composed of the following steps: First, the genotype frequencies are estimated from a set of initial values of haplotype frequencies. These haplotype frequencies are denoted $P_1^{(0)}, P_2^{(0)}, P_3^{(0)}, \ldots, P_H^{(0)}$. The initial values for the haplotype frequencies may be obtained from a random number generator or in some other way well known in the art. This step is referred to the Expectation step. The next step in the method, called the Maximization step, consists of using the estimates for the genotype frequencies to re-calculate the haplotype frequencies. The first iteration haplotype frequency estimates are denoted by $P_1^{(1)}, P_2^{(1)}, P_3^{(1)}, \ldots, P_H^{(1)}$. In general, the Expectation step at the $s^{th}$ iteration consists of calculating the probability of placing each phenotype into the different possible genotypes based on the haplotype frequencies of the previous iteration:

$$P(h_k, h_l)^{(s)} = \frac{n_j}{N}\left[\frac{P_j(h_k, h_l)^{(s)}}{P_j}\right], \qquad \text{Equation 3}$$

where $n_j$ is the number of individuals with the $j^{th}$ phenotype and $P_j(h_k,h_l)^{(s)}$ is the probability of genotype $h_k,h_l$ in phenotype j. In the Maximization step, which is equivalent to the gene-counting method (Smith, *Ann. Hum. Genet.*, 21:254–276, 1957), the haplotype frequencies are re-estimated based on the genotype estimates:

$$P_t^{(s+1)} = \frac{1}{2}\sum_{j=1}^{F}\sum_{i=1}^{c_j} \delta_{it} P_j(h_k, h_l)^{(s)}. \qquad \text{Equation 4}$$

Here, $\delta_{it}$ is an indicator variable which counts the number of occurrences that haplotype t is present in $i^{th}$ genotype; it takes on values 0, 1, and 2.

The E-M iterations cease when the following criterion has been reached. Using Maximum Likelihood Estimation (MLE) theory, one assumes that the phenotypes j are distributed multinomially. At each iteration s, one can compute the likelihood function L. Convergence is achieved when the difference of the log-likehood between two consecutive iterations is less than some small number, preferably $10^{-7}$.

Methods to Calculate Linkage Disequilibrium Between Markers

A number of methods can be used to calculate linkage disequilibrium between any two genetic positions, in practice linkage disequilibrium is measured by applying a statistical association test to haplotype data taken from a population.

Linkage disequilibrium between any pair of biallelic markers comprising at least one of the biallelic markers of the present invention ($M_i$, $M_j$) having alleles ($a_i/b_i$) at marker $M_i$ and alleles ($a_j/b_j$) at marker $M_j$ can be calculated for every allele combination ($a_i,a_j$; $a_i,b_j$; $b_i,a_j$ and $b_i,b_j$), according to the Piazza formula:

$$\Delta_{a_i a_j} = \sqrt{\theta 4} - \sqrt{(\theta 4 + \theta 3)(\theta 4 + \theta 2)},$$

where:

θ4=− −=frequency of genotypes not having allele $a_i$ at $M_i$ and not having allele $a_j$ at $M_j$ θ3=−+=frequency of genotypes not having allele $a_i$ at $M_i$ and having allele $a_j$ at $M_j$ θ2=+−=frequency of genotypes having allele $a_1$ at $M_i$ and not having allele $a_j$ at $M_j$ Linkage disequilibrium (LD) between pairs of biallelic markers ($M_i$, $M_j$) can also be calculated for every allele combination (ai,aj; ai,bj; bi,aj and bi,bj), according to the maximum-likelihood estimate (MLE) for delta (the composite genotypic disequilibrium coefficient), as described by Weir (Weir B. S., *Genetic Data Analysis, Sinauer Ass. Eds*, 1996). The MLE for the composite linkage disequilibrium is:

$$D_{aiaj}=(2n_1+n_2+n_3+n_4/2)/N-2(pr(a_i).pr(a_j))$$

Where $n_1=\Sigma$ phenotype ($a_i/a_i$, $a_j/a_j$), $n_2=\Sigma$ phenotype ($a_i/a_i$, $a_j/b_j$), $n_3=\Sigma$ phenotype ($a_i/b_i$, $a_j/a_j$), $n4=\Sigma$ phenotype ($a_i/b_i$, $a_j/b_j$) and N is the number of individuals in the sample.

This formula allows linkage disequilibrium between alleles to be estimated when only genotype, and not haplotype, data are available.

Another means of calculating the linkage disequilibrium between markers is as follows. For a couple of biallelic markers, $M_i(a_i/b_i)$ and $M_j(a_j/b_j)$, fitting the Hardy-Weinberg equilibrium, one can estimate the four possible haplotype frequencies in a given population according to the approach described above.

The estimation of gametic disequilibrium between ai and aj is simply:

$$D_{aiaj}=pr(\text{haplotype}(a_i,a_j))-pr(a_i).pr(a_j).$$

Where $pr(a_i)$ is the probability of allele $a_i$ and $pr(a_j)$ is the probability of allele $a_j$ and where $pr(\text{haplotype } (a_i, a_j))$ is estimated as in Equation 3 above.

For a couple of biallelic marker only one measure of disequilibrium is necessary to describe the association between $M_i$ and $M_j$.

Then a normalised value of the above is calculated as follows:

$$D'_{aiaj}=D_{aiaj}/\max(-pr(a_i).pr(a_j), -pr(b_i).pr(b_j)) \text{ with } D_{aiaj}<0$$

$$D'_{aiaj}=D_{aiaj}/\max(pr(b_i).pr(a_j), pr(a_i).pr(b_j)) \text{ with } D_{aiaj}>0$$

The skilled person will readily appreciate that other LD calculation methods can be used without undue experimentation.

Linkage disequilibrium among a set of biallelic markers having an adequate heterozygosity rate can be determined by genotyping between 50 and 1000 unrelated individuals, preferably between 75 and 200, more preferably around 100.

Testing for Association

Methods for determining the statistical significance of a correlation between a phenotype and a genotype, in this case an allele at a biallelic marker or a haplotype made up of such alleles, may be determined by any statistical test known in the art and with any accepted threshold of statistical significance being required. The application of particular methods and thresholds of significance are well with in the skill of the ordinary practitioner of the art.

Testing for association is performed by determining the frequency of a biallelic marker allele in case and control populations and comparing these frequencies with a statistical test to determine if their is a statistically significant difference in frequency which would indicate a correlation between the trait and the biallelic marker allele under study. Similarly, a haplotype analysis is performed by estimating the frequencies of all possible haplotypes for a given set of biallelic markers in case and control populations, and comparing these frequencies with a statistical test to determine if their is a statistically significant correlation between the haplotype and the phenotype (trait) under study. Any statistical tool useful to test for a statistically significant association between a genotype and a phenotype may be used. Preferably the statistical test employed is a chi-square test with one degree of freedom. A P-value is calculated (the P-value is the probability that a statistic as large or larger than the observed one would occur by chance).

Statistical Significance

In preferred embodiments, significance for diagnosis purposes, either as a positive basis for further diagnostic tests or as a preliminary starting point for early preventive therapy, the p value related to a biallelic marker association is preferably about 1×10−2 or less, more preferably about 1×10−4 or less, for a single biallelic marker analysis and about 1×10−3 or less, still more preferably 1×10−6 or less and most preferably of about 1×10−8 or less, for a haplotype analysis involving several markers. These values are believed to be applicable to any association studies involving single or multiple marker combinations.

The skilled person can use the range of values set forth above as a starting point in order to carry out association studies with biallelic markers of the present invention. In doing so, significant associations between the biallelic markers of the present invention and responses to drugs or side effects upon treatment with drugs or diseases involving the metabolic conversion of xenobiotics can be revealed and used for diagnosis and drug screening purposes.

Phenotype Permutation

In order to confirm the statistical significance of the first stage haplotype analysis described above, it might be suitable to perform further analyses in which genotyping data from case-control individuals are pooled and randomised with respect to the trait phenotype. Each individual genotyping data is randomly allocated to two groups, which contain the same number of individuals as the case-control populations used to compile the data obtained in the first stage. A second stage haplotype analysis is preferably run on these artificial groups, preferably for the markers included in the haplotype of the first stage analysis showing the highest relative risk coefficient. This experiment is reiterated preferably at least between 100 and 10000 times. The repeated iterations allow the determination of the percentage of obtained haplotypes with a significant p-value level.

Assessment of Statistical Association

To address the problem of false positives similar analysis may be performed with the same case-control populations in random genomic regions. Results in random regions and the candidate region are compared as described in U.S. Provisional Patent Application entitled "Methods, software and apparati for identifying genomic regions harbouring a gene associated with a detectable trait".

Evaluation of Risk Factors

The association between a risk factor (in genetic epidemiology the risk factor is the presence or the absence of a certain allele or haplotype at marker loci) and a disease is measured by the odds ratio (OR) and by the relative risk (RR). If $P(R^+)$ is the probability of developing the disease for individuals with R and $P(R^-)$ is the probability for individuals without the risk factor, then the relative risk is simply the ratio of the two probabilities, that is:

$$RR=P(R^+)/P(R^-)$$

In case-control studies, direct measures of the relative risk cannot be obtained because of the sampling design. However, the odds ratio allows a good approximation of the relative risk for low-incidence diseases and can be calculated:

$$OR = \left[\frac{F^+}{1-F^+}\right] / \left[\frac{F^-}{(1-F^-)}\right]$$

$F^+$ is the frequency of the exposure to the risk factor in cases and F- is the frequency of the exposure to the risk factor in controls. $F^+$ and $F^-$ are calculated using the allelic or haplotype frequencies of the study and further depend on the underlying genetic model (dominant, recessive, additive . . . ).

One can further estimate the attributable risk (AR) which describes the proportion of individuals in a population exhibiting a trait due to a given risk factor. This measure is important in quantitating the role of a specific factor in disease etiology and in terms of the public health impact of a risk factor. The public health relevance of this measure lies in estimating the proportion of cases of disease in the population that could be prevented if the exposure of interest were absent. AR is determined as follows:

$$AR = P_E(RR-1)/(P_E(RR-1)+1)$$

AR is the risk attributable to a biallelic marker allele or a biallelic marker haplotype. $P_E$ is the frequency of exposure to an allele or a haplotype within the population at large; and RR is the relative risk which, is approximated with the odds ratio when the trait under study has a relatively low incidence in the general population.

D. Identification of Biallelic Markers in Linkage Disequilibrium with the Biallelic Markers of the Invention Once a first biallelic marker has been identified in a genomic region of interest, the practitioner of ordinary skill in the art, using the teachings of the present invention, can easily identify additional biallelic markers in linkage disequilibrium with this first marker. As mentioned before any marker in linkage disequilibrium with a first marker associated with a trait will be associated with the trait. Therefore, once an association has been demonstrated between a given biallelic marker and a trait, the discovery of additional biallelic markers associated with this trait is of great interest in order to increase the density of biallelic markers in this particular region. The causal gene or mutation will be found in the vicinity of the marker or set of markers showing the highest correlation with the trait.

Identification of additional markers in linkage disequilibrium with a given marker involves: (a) amplifying a genomic fragment comprising a first biallelic marker from a plurality of individuals; (b) identifying of second biallelic markers in the genomic region harboring said first biallelic marker; (c) conducting a linkage disequilibrium analysis between said first biallelic marker and second biallelic markers; and (d) selecting said second biallelic markers as being in linkage disequilibrium with said first marker. Subcombinations comprising steps (b) and (c) are also contemplated.

Methods to identify biallelic markers and to conduct linkage disequilibrium analysis are described herein and can be carried out by the skilled person without undue experimentation. The present invention then also concerns biallelic markers which are in linkage disequilibrium with the specific biallelic markers shown in Table 11(A–B) and which are expected to present similar characteristics in terms of their respective association with a given trait.

E. Identification of Functional Mutations

Once a positive association is confirmed with a biallelic marker of the present invention, the associated candidate gene can be scanned for mutations by comparing the sequences of a selected number of trait positive and trait negative or control individuals. In a preferred embodiment, functional regions such as exons and splice sites, promoters and other regulatory regions of the candidate gene are scanned for mutations. Preferably, trait positive individuals carry the haplotype shown to be associated with the trait and trait negative individuals do not carry the haplotype or allele associated with the trait. The mutation detection procedure is essentially similar to that used for biallelic site identification.

The method used to detect such mutations generally comprises the following steps: (a) amplification of a region of the candidate gene comprising a biallelic marker or a group of biallelic markers associated with the trait from DNA samples of trait positive patients and trait negative controls; (b) sequencing of the amplified region; (c) comparison of DNA sequences from trait-positive patients and trait-negative controls; and (d) determination of mutations specific to trait-positive patients. Subcombinations which comprise steps (b) and (c) are specifically contemplated.

It is preferred that candidate polymorphisms be then verified by screening a larger population of cases and controls by means of any genotyping procedure such as those described herein, preferably using a microsequencing technique in an individual test format. Polymorphisms are considered as candidate mutations when present in cases and controls at frequencies compatible with the expected association results.

Identification of mutations and low frequency polymorphisms in exons 3–5, in the 5'UTR region and in the 3' flanking region of the MGST-II gene is further described in Example 5. Eight polymorphisms were identified in the region of the MGST-II gene that was scanned. Three mutations were identified in the 3'UTR region. One mutation in exon 4 causes an amino acid substitution (Tyr→His) at the polypeptide level. A mutation in exon 5 introduces a stop codon into the ORF leading to the expression of a truncated MGST-II polypeptide. These mutations modify the specificity, activity and function of the MGST-II enzyme and therefore represent functional mutations of the MGST-II gene. Candidate polymorphisms and mutations suspected of being responsible for the detectable phenotype, such as hepatotoxicity to zileuton or asthma, can be confirmed by screening a larger population of affected and unaffected individuals using any of the genotyping procedures described herein. Preferably the microsequencing technique is used. In a preferred embodiment trait positive and trait negative populations are genotyped for the candidate polymorphisms identified in Example 5 (10-286-289, 10-286-345, 10-286-375, 10-523-232, 10-289-201, 10-290-37, 10-290-326 and 10-290-328) most preferably for the mutations in exons 4 and 5 (10-289-201 and 10-290-37). Polymorphisms are considered as candidate "trait-causing" mutations when they exhibit a statistically significant correlation with the detectable phenotype.

V. Biallelic Markers of the Invention in Methods of Genetic Diagnostics

The biallelic markers of the present invention can also be used to develop diagnostics tests capable of identifying individuals who express a detectable trait as the result of a specific genotype or individuals whose genotype places them at risk of developing a detectable trait at a subsequent time. The trait analyzed using the present diagnostics may be any detectable trait, including a response to a drug or side effects to a drug upon treatment or a disease involving the metabolic conversion of xenobiotics.

The diagnostic techniques of the present invention may employ a variety of methodologies to determine whether a test subject has a biallelic marker pattern associated with an increased risk of developing a detectable trait or whether the individual suffers from a detectable trait as a result of a particular mutation, including methods which enable the analysis of individual chromosomes for haplotyping, such as family studies, single sperm DNA analysis or somatic hybrids.

The present invention provides diagnostic methods to determine whether an individual is at risk of developing a disease or suffers from a disease resulting from a mutation or a polymorphism in a candidate gene of the present invention. The present invention also provides methods to determine whether an individual is likely to respond positively to a therapeutic agent or whether an individual is at risk of developing an adverse side effect to a therapeutic agent.

These methods involve obtaining a nucleic acid sample from the individual and, determining, whether the nucleic acid sample contains at least one allele or at least one biallelic marker haplotype, indicative of a risk of developing the trait or indicative that the individual expresses the trait as a result of possessing a particular candidate gene polymorphism or mutation (trait-causing allele).

Preferably, in such diagnostic methods, a nucleic acid sample is obtained from the individual and this sample is genotyped using methods described herein in "Methods of Genotyping an Individual for Biallelic Markers." The diagnostics may be based on a single biallelic marker or on a group of biallelic markers.

In each of these methods, a nucleic acid sample is obtained from the test subject and the biallelic marker pattern of one or more of the biallelic markers listed in Table 11(A–B) is determined.

In one embodiment, a PCR amplification is conducted on the nucleic acid sample to amplify regions in which polymorphisms associated with a detectable phenotype have been identified. The amplification products are sequenced to determine whether the individual possesses one or more polymorphisms associated with a detectable phenotype. The primers used to generate amplification products may comprise the primers listed in Table 17. Alternatively, the nucleic acid sample is subjected to microsequencing reactions as described above to determine whether the individual possesses one or more polymorphisms associated with a detectable phenotype resulting from a mutation or a polymorphism in a candidate gene. The primers used in the microsequencing reactions may include the primers listed in Table 16. In another embodiment, the nucleic acid sample is contacted with one or more allele specific oligonucleotide probes which, specifically hybridize to one or more candidate gene alleles associated with a detectable phenotype. The probes used in the hybridization assay may include the probes listed in Table 18. Diagnostic kits comprising polynucleotides of the present invention are further described in section I.

These diagnostic methods are extremely valuable as they can, in certain circumstances, be used to initiate preventive treatments or to allow an individual carrying a significant haplotype to foresee warning signs such as minor symptoms. For diseases in which attacks may be extremely violent and sometimes fatal if not treated on time, the knowledge of a potential predisposition, even if this predisposition is not absolute, might contribute in a very significant manner to treatment efficacy. Similarly, a diagnosed predisposition to a potential side effect could immediately direct the physician toward a treatment for which such side effects have not been observed during clinical trials.

Diagnostics, which analyze and predict response to a drug or side effects to a drug, may be used to determine whether an individual should be treated with a particular drug. For example, if the diagnostic indicates a likelihood that an individual will respond positively to treatment with a particular drug, the drug may be administered to the individual. Conversely, if the diagnostic indicates that an individual is likely to respond negatively to treatment with a particular drug, an alternative course of treatment may be prescribed. A negative response may be defined as either the absence of an efficacious response or the presence of toxic side effects.

Clinical drug trials represent another application for the markers of the present invention. One or more markers indicative of response to a drug or to side effects to a drug may be identified using the methods described above. Thereafter, potential participants in clinical trials of such an agent may be screened to identify those individuals most likely to respond favorably to the drug and exclude those likely to experience side effects. In that way, the effectiveness of drug treatment may be measured in individuals who respond positively to the drug, without lowering the measurement as a result of the inclusion of individuals who are unlikely to respond positively in the study and without risking undesirable safety problems.

In a preferred embodiment the identity of the nucleotide present at, at least one, biallelic marker selected from the group consisting of 12-455-326, 12-453-429, 12-454-363, 12-441-233, 12-461-299, 12-426-154, 12-424-198, 12-716-295, 10-428-219, 12-720-80, 12-156-91, 12-140-134, 12-653-423, 10-471-84, 10-471-85, 10-470-25, 12-652-203, 12-637-219, 12-721-440 and 10-420-284 is determined, and optionally wherein the detectable trait is asthma, or optionally the detectable trait is hepatotoxicity to the anti-asthmatic drug zileuton. In another preferred embodiment the identity of the nucleotide present at, at least one of the polymorphic sites selected from the group consisting of 12-447-58, 12-455-326, 12-461-299, 12-453-429, 12-424-198, 12-454-363, 12-716-295, 10-428-219, 12-720-80, 10-420-248, 12-721-440, 12-653-423, 10-470-25, 10-471-84, 10-471-85, 12-637-219 and 12-652-203 is determined, and optionally wherein the detectable trait is asthma. In another preferred embodiment the identity of the nucleotide present at, at least one of the polymorphic sites selected from the group consisting of 12-453-429, 12-455-326, 12-453-429, 12-454-363, 12-441-233, 12-461-299, 12-426-154, 12-424-198, 12-716-295, 10-428-219, 12-720-80, 12-156-91, 12-140-134, 12-653-423, 10-471-84, 10-471-85, 10-470-25, 12-652-203, 12-637-219, 12-721–440, and 10-420-284 is determined, and optionally wherein the detectable trait is hepatotoxicity to the anti-asthmatic drug zileuton. Diagnostic kits comprising polynucleotides of the present invention are further described in "Biallelic Markers and Polynucleotides Comprising Biallelic Markers."

VI. Association of Biallelic Markers of the Invention with Asthma

In the context of the present invention, an association between the MGST-II, ME1, UGT1A7 and UGT2B4 genes and asthma was established. See Example 3.

Asthma affects over 5% of the population in industrialized countries. It is increasing in prevalence and severity and has a rising mortality (Rang H. P., Ritter J. M. and Dale M. M.; *Pharmacology;* Churchill Livingstone, N.Y., 1995). Bronchial asthma is a multifactorial syndrome rather than a single disease, defined as airway obstruction characterized by inflammatory changes in the airways and bronchial hyper-responsiveness. In addition to the evidenced impact of environmental factors on the development of asthma, patterns of clustering and segregation in asthmatic families have suggested a genetic component to asthma. However the lack of a defined and specific asthma phenotype and of suitable markers for genetic analysis is proving to be a major hurdle for reliably identifying genes associated with asthma. The identification of genes implicated in asthma would represent a major step towards the identification of new molecular targets for the development of anti-asthma drugs. Moreover there is no straightforward physiological or biological blood test for the asthmatic state. As a result, adequate asthma treatment is often delayed, thereby allowing the inflammation process to better establish itself. Thus, there is a need for the identification of asthma susceptibility genes in order to develop an efficient and reliable asthma diagnostic test.

As mentioned above, products of arachidonic acid metabolism are important inflammatory mediators and have been involved in a number of inflammatory diseases, including asthma. More specifically, prostaglandins and leukotrienes are thought to play a major role in the inflammatory process observed in asthma patients.

In order to investigate and identify a genetic origin to asthma, a candidate gene scan was conducted. This approach comprised:
a) selecting candidate genes potentially involved in the pathological pathway of interest, in this case arachidonic acid metabolism, and
b) identifying biallelic markers in those genes, and finally
c) conducting association studies to identify biallelic marker alleles or haplotypes associated with asthma.

Further details concerning this association study are provided in Example 3, results are briefly summarized below.

Two groups of independent individuals were used in this association study in accordance with the invention: the case-control populations. The two groups corresponded to 297 asthmatic individuals and 178 control individuals. The trait positive asthma population was mostly composed of individuals from Caucasian ethnic background (>90%). The control population was composed of individuals from a random US Caucasian population.

In the association study described in Example 3, several biallelic marker haplotypes were shown to be significantly associated with asthma. A preferred haplotype consisting of three biallelic markers (12-455-326, 12-453-429 and 12-424-198) presented a p-value of $3.2\ 10^{-5}$. Another preferred haplotype consisting of four biallelic markers (12-455-326, 12-453-429, 12-424-198 and 12-454-363) had a p-value of $1.2\ 10^{-6}$. Phenotypic permutation tests confirmed the statistical significance of these results. These haplotypes can therefore be considered to be significantly associated with asthma.

This information is extremely valuable. The knowledge of a potential genetic predisposition to asthma, even if this predisposition is not absolute, might contribute in a very significant manner to treatment efficacy of asthma patients and to the development of new therapeutic and diagnostic tools.

VII. Association of Biallelic Markers of the Invention with Hepatotoxicity to Anti-Asthma Drug Zileuton (Zyflo™)

In the context of the present invention, an association between the the MGST-II, ME1, UGT1A7 and UGT2B4 genes and side effects related to treatment with the anti-asthmatic drug zileuton was discovered.

As mentioned above, bronchial asthma is a multifactorial syndrome rather than a single disease, defined as airway obstruction characterized by inflammatory changes in the airways and bronchial hyper-responsiveness. Although initially reversible with bronchodilators, airway obstruction becomes increasingly irreversible if treated poorly. Asthma management therefore relies on early and regular use of drugs that control the disease. As a consequence, there is a strong need for efficient and safe therapeutic opportunities for patients with asthma. There are two main categories of anti-asthmatic drugs—bronchodilators and anti-inflammatory agents. There is now general agreement on the need to implement early anti-inflammatory treatment rather than relying on symptomatic treatment with bronchiodilators alone. The leukotrienes, a family of proinflammatory mediators arising via arachidonic acid metabolism, have been implicated in the inflammatory cascade that occurs in asthmatic airways. Of great relevance to the pathogenesis of asthma are the 5-lipoxygenase and the 5-lipoxygenase activating protein (FLAP), which catalyze the initial steps in the biosynthesis of leukotrienes from arachidonic acid. Given the significant role of the inflammatory process in asthma, pharmacological agents, such as leukotriene antagonists, FLAP inhibitors and 5-lipoxygenase inhibitors have been developed.

Zileuton (Zyflo™) is an active inhibitor of 5-lipoxygenase, the enzyme that catalyzes the formation of leukotrienes from arachidonic acid, indicated for prophylaxis and chronic treatment of asthma. A minority of zileuton-treated patients develop liver function abnormalities as close monitoring revealed that elevations of liver function tests may occur during treatment with zileuton. In the present invention the ALT test (serum level of alanine aminotransferase) was used, which is considered the most sensitive indicator of liver injury.

In order to investigate and identify a genetic origin to zileuton-associated hepatotoxicity, a candidate gene scan was conducted. This approach comprised:
a) selecting candidate genes potentially involved in the pathological pathway of interest or in the metabolism of zileuton, and
b) identifying biallelic markers in those genes, and finally
c) conducting association studies to identify biallelic marker alleles or haplotypes associated with elevations of liver function tests upon treatment with zileuton.

Further details concerning this association study are provided in Example 4, results are briefly summarized below.

Two groups of unrelated individuals were used in this association study in accordance with the invention: the case-control populations. The case population was composed of 89 asthmatic individuals treated with zileuton showing zileuton-associated hepatotoxicity monitored by the serum level of alanine aminotransferase (ALT) and the control population was composed of 208 asthmatic individuals treated with zileuton and having no increased serum ALT level.

The association study conducted with the biallelic markers derived from the MGST-II locus showed that several haplotypes were significantly associated with zileuton-associated hepatotoxicity. A preferred haplotype consisting of three biallelic markers (12-441-233, 12-461-299 and 12-453-429) presented a p-value of $1.5\ 10^{-5}$ and an odd ratio of 3.63. A second preferred haplotype consisting of four biallelic markers (12-441-233, 12-461-299, 12-453-429 and 12-426-154) had a p-value of $5.2\ 10^{-7}$ and an odd ratio of 5.75.

This information is extremely valuable. The knowledge of a potential genetic predisposition to hepatotoxicity upon treatment with zileuton, even if this predisposition is not absolute, might contribute in a very significant manner to the safety of asthma treatment and to the development of diagnostic tools.

Similar association studies, with different case-control populations, can be routinely carried out by the skilled technician using the biallelic markers of the present invention in order to identify other association between traits and DME and MGST-II-related biallelic marker alleles or haplotypes.

VI. Computer-Related Embodiments

As used herein the term "nucleic acid codes of the invention" encompass the nucleotide sequences comprising, consisting essentially of, or consisting of any one of the following: a) a contiguous span of at least 12, 15, 18, 20, 25, 30, 35, 40, 50, 60, 70, 80, 90, 100, 150, 200, 500 or 1000 nucleotides, to the extent that a polynucleotide of these lengths is consistent with the lengths of the particular Sequence ID, of a sequence selected from the group consisting of the sequences described in Table 12, and the complements thereof; b) a contiguous span of at least 12, 15, 18, 20, 25, 30, 35, 40, 50, 60, 70, 80, 90, 100, 150, 200, 500 or 1000 nucleotides, to the extent that a polynucleotide of these lengths is consistent with the lengths of the particular Sequence ID, of a sequence selected from the group consisting of the sequences described in Table 13, and the complements thereof, c) a contiguous span of at least 12, 15, 18, 20, 25, 30, 35, 40, 50, 60, 70, 80, 90, 100, 150, 200, or 500 nucleotides, to the extent that a polynucleotide of these lengths is consistent with the lengths of the particular Sequence ID, of a sequence selected from the group consisting of the sequences described in Table 16, more preferably a set of markers or sequences consisting of those markers or sequences found in SEQ ID Nos. 3, 5, 9, 13–15, 25, 31, 33, 37, 38, 41, 323, 345, 351–353, 357, 377, and 380, and the complements thereof, wherein said span includes an DME-related biallelic marker, preferably an DME-related biallelic marker described in Table 1 1(A–B), preferably the biallelic markers found in Tables 19, 20, 21 and 22; or more preferably the biallelic markers found in SEQ ID Nos. 3, 5, 9, 13–15, 25, 31, 33, 37, 38, 41, 323, 345, 351–353, 357, 377, 380, in said sequence with the alternative allele present at said biallelic marker.

The "nucleic acid codes of the invention" further encompass nucleotide sequences homologous to a contiguous span of at least 30, 35, 40, 50, 60, 70, 80, 90, 100, 150, 200, 500 or 1000 nucleotides, to the extent that a contiguous span of these lengths is consistent with the lengths of the particular Sequence ID, of a sequence selected from the group consisting of the sequences described in Tables 12, 13 and 16 and the complements thereof. Homologous sequences refer to a sequence having at least 99%, 98%, 97%, 96%, 95%, 90%, 85%, 80%, or 75% homology to these contiguous spans. Homology may be determined using any method described herein, including BLAST2N with the default parameters or with any modified parameters. Homologous sequences also may include RNA sequences in which uridines replace the thymines in the nucleic acid codes of the invention. It will be appreciated that the nucleic acid codes of the invention can be represented in the traditional single character format (See the inside back cover of Stryer, Lubert. *Biochemistry*, 3$^{rd}$ edition. W. H Freeman & Co., New York.) or in any other format or code which records the identity of the nucleotides in a sequence.

It will be appreciated by those skilled in the art that the nucleic acid codes of the invention, one or more of the polypeptide codes of SEQ ID Nos. 488 and 489 can be stored, recorded, and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid codes of the invention and one or more of the polypeptide codes of SEQ ID Nos. 488 and 489. Another aspect of the present invention is a computer readable medium having recorded thereon at least 2, 5, 10, 15, 20, 25, 30, or 50 nucleic acid codes of the invention, and the complements thereof. Another aspect of the present invention is a computer readable medium having recorded thereon at least 2, 5, 10, 15, 20, 25, 30, or 50 polypeptide codes of SEQ ID Nos. 488 and 489.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Embodiments of the present invention include systems, particularly computer systems which store and manipulate the sequence information described herein. As used herein, "a computer system" refers to the hardware components, software components, and data storage components used to analyze the nucleotide sequences of the nucleic acid codes of the invention, or the amino acid sequences of the polypeptide codes of SEQ ID Nos. 488 and 489. In one embodiment, the computer system is a Sun Enterprise 1000 server (Sun Microsystems, Palo Alto, Calif.). The computer system preferably includes a processor for processing, accessing and manipulating the sequence data. The processor can be any well-known type of central processing unit, such as the Pentium III from Intel Corporation, or similar processor from Sun, Motorola, Compaq or International Business Machines. Preferably, the computer system is a general-purpose system that comprises the processor and one or more internal data storage components for storing data, and one or more data retrieving devices for retrieving the data stored on the data storage components. A skilled artisan can readily appreciate that any one of the currently available computer systems are suitable. In one particular embodiment, the computer system includes a processor connected to a bus which is connected to a main memory (preferably implemented as RAM) and one or more internal data storage devices, such as a hard drive and/or other computer readable media having data recorded thereon. In some embodiments, the computer system further includes one or more data-retrieving device for reading the data stored on the internal data storage devices. The data-retrieving device may represent, for example, a floppy disk drive, a compact disk drive, a magnetic tape drive, etc. In some embodiments, the internal data storage device is a removable computer readable medium such as a floppy disk, a compact disk, a magnetic tape, etc. containing control logic and/or data recorded thereon. The computer system may advantageously include or be programmed by appropriate software for reading the control logic and/or the data from the data storage component once inserted in the data-retrieving device. The computer system includes a display which is used to display output to a computer user. It should be also noted that the computer system can be linked to other computer systems in a network or wide area network to provide centralized access to the computer system. Software for accessing and processing the nucleotide sequences of the nucleic acid codes of the invention, or the amino acid sequences of the polypeptide codes of SEQ ID Nos. 488 and 489 (such as search tools, compare tools, and modeling tools etc.) may reside in main memory during execution. In some embodiments, the computer system may further comprise a sequence comparer for comparing the above-described nucleic acid codes of the invention or polypeptide codes of SEQ ID Nos. 488 and 489 stored on a computer readable medium to reference nucleotide or polypeptide sequences stored on a computer readable medium. A "sequence comparer" refers to one or more programs which are implemented on the computer system to compare a nucleotide or polypeptide sequence with other nucleotide or polypeptide sequences and/or compounds including but not limited to peptides, peptidomimetics, and chemicals stored within the data storage means. For example, the sequence comparer may compare the nucleotide sequences of the nucleic acid codes of the invention, or the amino acid sequences of the polypeptide codes of SEQ ID Nos. 488 and 489 stored on a computer readable medium to reference sequences stored on a computer readable medium to identify homologies, motifs implicated in biological function, or structural motifs. The various sequence comparer programs identified elsewhere in this patent specification are particularly contemplated for use in this aspect of the invention.

One embodiment is a process for comparing a new nucleotide or protein sequence with a database of sequences in order to determine the homology levels between the new sequence and the sequences in the database. The database of sequences can be a private database stored within the computer system, or a public database such as GENBANK, PIR OR SWISSPROT that is available through the Internet.

The process begins at a start state and then moves to a state wherein the new sequence to be compared is stored to a memory in a computer system. As discussed above, the memory could be any type of memory, including RAM or an internal storage device. The process then moves to a state wherein a database of sequences is opened for analysis and comparison. The process then moves to a state wherein the first sequence stored in the database is read into a memory on the computer. A comparison is then performed at a state to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system. Once a comparison of the two sequences has been performed at the state, a determination is made at a decision state whether the two sequences are the same. Of course, the term "same" is not limited to sequences that are absolutely identical. Sequences that are within the homology parameters entered by the user will be marked as "same" in the process. If a determination is made that the two sequences are the same, the process moves to a state wherein the name of the sequence from the database is displayed to the user. This state notifies the user that the sequence with the displayed name fulfills the homology constraints that were entered. Once the name of the stored sequence is displayed to the user, the process moves to a decision state wherein a determination is made whether more sequences exist in the database. If no more sequences exist in the database, then the process terminates at an end state. However, if more sequences do exist in the database, then the process moves to a state wherein a pointer is moved to the next sequence in the database so that it can be compared to the new sequence. In this manner, the new sequence is aligned and compared with every sequence in the database. It should be noted that if a determination had been made at the decision state that the sequences were not homologous, then the process would move immediately to the decision state in order to determine if any other sequences were available in the database for comparison. Accordingly, one aspect of the present invention is a computer system comprising a processor, a data storage device having stored thereon a nucleic acid code of the invention or a polypeptide code of SEQ ID Nos. 488 and 489, a data storage device having retrievably stored thereon reference nucleotide sequences or polypeptide sequences to be compared to the nucleic acid code of the invention or polypeptide code of SEQ ID Nos. 488 and 489 and a sequence comparer for conducting the comparison. The sequence comparer may indicate a homology level between the sequences compared or identify structural motifs in the above described nucleic acid code of the invention and polypeptide codes of SEQ ID Nos. 488 and 489 or it may identify structural motifs in sequences which are compared to these nucleic acid codes and polypeptide codes. In some embodiments, the data storage device may have stored thereon the sequences of at least 2, 5, 10, 15, 20, 25, 30, or 50 of the nucleic acid codes of the invention or polypeptide codes of SEQ ID Nos. 488 and 489.

Another aspect of the present invention is a method for determining the level of homology between a nucleic acid code of the invention and a reference nucleotide sequence, comprising the steps of reading the nucleic acid code and the reference nucleotide sequence through the use of a computer program which determines homology levels and determining homology between the nucleic acid code and the reference nucleotide sequence with the computer program. The computer program may be any of a number of computer programs for determining homology levels, including those specifically enumerated herein, including BLAST2N with the default parameters or with any modified parameters. The method may be implemented using the computer systems described above. The method may also be performed by reading 2, 5, 10, 15, 20, 25, 30, or 50 of the above described nucleic acid codes of the invention through use of the computer program and determining homology between the nucleic acid codes and reference nucleotide sequences .

One embodiment is a process in a computer for determining whether two sequences are homologous. The process begins at a start state and then moves to a state wherein a first sequence to be compared is stored to a memory. The second sequence to be compared is then stored to a memory at a state. The process then moves to a state wherein the first character in the first sequence is read and then to a state wherein the first character of the second sequence is read. It should be understood that if the sequence is a nucleotide sequence, then the character would normally be either A, T, C, G or U. If the sequence is a protein sequence, then it should be in the single letter amino acid code so that the first and sequence sequences can be easily compared.

A determination is then made at a decision state whether the two characters are the same. If they are the same, then the process moves to a state wherein the next characters in the first and second sequences are read. A determination is then made whether the next characters are the same. If they are, then the process continues this loop until two characters are not the same. If a determination is made that the next two characters are not the same, the process moves to a decision state to determine whether there are any more characters either sequence to read. If there aren't any more characters to read, then the process moves to a state wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%. Alternatively, the computer program may be a computer program which compares the nucleotide sequences of the nucleic acid codes of the present invention, to reference nucleotide sequences in order to determine whether the nucleic acid code of SEQ ID Nos. 1–977 differs from a reference nucleic acid sequence at one or more positions. Optionally such a program records the length and identity of inserted, deleted or substituted nucleotides with respect to the sequence of either the reference polynucleotide or the nucleic acid code of SEQ ID Nos. 1–977. In one embodiment, the computer program may be a program which determines whether the nucleotide sequences of the nucleic acid codes of the invention contain a biallelic marker or single nucleotide polymorphism (SNP) with respect to a reference nucleotide sequence. This single nucleotide polymorphism may comprise a single base substitution, insertion, or deletion, while this biallelic marker may comprise about one to ten consecutive bases substituted, inserted or deleted.

Another aspect of the present invention is a method for determining the level of homology between a polypeptide code of SEQ ID Nos. 488 and 489 and a reference polypeptide sequence, comprising the steps of reading the polypeptide code of SEQ ID Nos. 488 and 489 and the reference polypeptide sequence through use of a computer program which determines homology levels and determining homology between the polypeptide code and the reference polypeptide sequence using the computer program.

Accordingly, another aspect of the present invention is a method for determining whether a nucleic acid code of the invention differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some embodiments, the computer program is a program which identifies single nucleotide polymorphisms. The method may be implemented by the computer systems described above. The method may also be performed by reading at least 2, 5, 10, 15, 20, 25, 30, or 50 of the nucleic acid codes of the invention and the reference nucleotide sequences through the use of the computer program and identifying differences between the nucleic acid codes and the reference nucleotide sequences with the computer program. In other embodiments the computer based system may further comprise an identifier for identifying features within the nucleotide sequences of the nucleic acid codes of the invention or the amino acid sequences of the polypeptide codes of SEQ ID Nos. 488 and 489. An "identifier" refers to one or more programs which identifies certain features within the above-described nucleotide sequences of the nucleic acid codes of the invention or the amino acid sequences of the polypeptide codes of SEQ ID Nos. 488 and 489. In one embodiment, the identifier may comprise a program which identifies an open reading frame in the cDNAs codes of SEQ ID Nos. 486 and 487.

One embodiment is an identifier process for detecting the presence of a feature in a sequence. The process begins at a start state and then moves to a state wherein a first sequence that is to be checked for features is stored to a memory in the computer system. The process then moves to a state wherein a database of sequence features is opened. Such a database would include a list of each feature's attributes along with the name of the feature. For example, a feature name could be "Initiation Codon" and the attribute would be "ATG." Another example would be the feature name "TAATAA Box" and the feature attribute would be "TAATAA". An example of such a database is produced by the University of Wisconsin Genetics Computer Group (world wide web site: gcg.com). Once the database of features is opened at the state, the process moves to a state wherein the first feature is read from the database. A comparison of the attribute of the first feature with the first sequence is then made at a state. A determination is then made at a decision state whether the attribute of the feature was found in the first sequence. If the attribute was found, then the process moves to a state wherein the name of the found feature is displayed to the user. The process then moves to a decision state wherein a determination is made whether move features exist in the database. If no more features do exist, then the process terminates at an end state. However, if more features do exist in the database, then the process reads the next sequence feature at a state and loops back to the state wherein the attribute of the next feature is compared against the first sequence. It should be noted, that if the feature attribute is not found in the first sequence at the decision state, the process moves directly to the decision state in order to determine if any more features exist in the database. In another embodiment, the identifier may comprise a molecular modeling program which determines the 3-dimensional structure of the polypeptides codes of SEQ ID Nos. 488 and 489. In some embodiments, the molecular modeling program identifies target sequences that are most compatible with profiles representing the structural environments of the residues in known three-dimensional protein structures. (See, e.g., Eisenberg et al., U.S. Pat. No. 5,436,850 issued Jul. 25, 1995, the disclosure of which is incorporated herein by reference in its entirety). In another technique, the known three-dimensional structures of proteins in a given family are superimposed to define the structurally conserved regions in that family. This protein modeling technique also uses the known three-dimensional structure of a homologous protein to approximate the structure of the polypeptide codes of SEQ ID Nos. 488 and 489. (See e.g., Srinivasan, et al., U.S. Pat. No. 5,557,535 issued Sep. 17, 1996, the disclosure of which is incorporated herein by reference in its entirety). Conventional homology modeling techniques have been used routinely to build models of proteases and antibodies. (Sowdhamini et al., Protein Engineering 10:207, 215 (1997), the disclosure of which is incorporated herein by reference in its entirety). Comparative approaches can also be used to develop three-dimensional protein models when the protein of interest has poor sequence identity to template proteins. In some cases, proteins fold into similar three-dimensional structures despite having very weak sequence identities. For example, the three-dimensional structures of a number of helical cytokines fold in similar three-dimensional topology in spite of weak sequence homology. The recent development of threading methods now enables the identification of likely folding patterns in a number of situations where the structural relatedness between target and template(s) is not detectable at the sequence level. Hybrid methods, in which fold recognition is performed using Multiple Sequence Threading (MST), structural equivalencies are deduced from the threading output using a distance geometry program DRAGON to construct a low resolution model, and a full-atom representation is constructed using a molecular modeling package such as QUANTA.

According to this 3-step approach, candidate templates are first identified by using the novel fold recognition algorithm MST, which is capable of performing simultaneous threading of multiple aligned sequences onto one or more 3-D structures. In a second step, the structural equivalencies obtained from the MST output are converted into interresidue distance restraints and fed into the distance geometry program DRAGON, together with auxiliary information obtained from secondary structure predictions. The program combines the restraints in an unbiased manner and rapidly generates a large number of low resolution model confirmations. In a third step, these low resolution model confirmations are converted into full-atom models and subjected to energy minimization using the molecular modeling package QUANTA. (See e.g., Aszódi et al., Proteins: Structure, Function, and Genetics, Supplement 1:38–42 (1997), the disclosure of which is incorporated herein by reference in its entirety).

The results of the molecular modeling analysis may then be used in rational drug design techniques to identify agents which modulate the activity of the polypeptide codes of SEQ ID Nos. 488 and 489. Accordingly, another aspect of the present invention is a method of identifying a feature within the nucleic acid codes of the invention or the polypeptide codes of SEQ ID Nos. 488 and 489 comprising reading the nucleic acid code(s) or the polypeptide code(s) through the use of a computer program which identifies features therein and identifying features within the nucleic acid code(s) or polypeptide code(s) with the computer program. In one embodiment, computer program comprises a computer program which identifies open reading frames. In a further embodiment, the computer program identifies structural motifs in a polypeptide sequence. In another embodiment, the computer program comprises a molecular modeling program. The method may be performed by reading a single sequence or at least 2, 5, 10, 15, 20, 25, 30, or 50 of the nucleic acid codes of the invention or the polypeptide codes of SEQ ID Nos. 488 and 489 through the use of the computer program and identifying features within the nucleic acid codes or polypeptide codes with the computer program. The nucleic acid codes of the invention or the polypeptide codes of SEQ ID Nos. 488 and 489 may be stored and manipulated in a variety of data processor programs in a variety of formats. For example, the nucleic acid codes of the invention or the polypeptide codes of SEQ ID Nos. 488 and 489 may be stored as text in a word processing file, such as MicrosoftWORD or WORDPERFECT or as an ASCII file in a variety of database programs familiar to those of skill in the art, such as DB2, SYBASE, or ORACLE. In addition, many computer programs and databases may be used as sequence comparers, identifiers, or sources of reference nucleotide or polypeptide sequences to be compared to the nucleic acid codes of the invention or the polypeptide codes of SEQ ID Nos. 488 and 489. The following list is intended not to limit the invention but to provide guidance to programs and databases which are useful with the nucleic acid codes of the invention or the polypeptide codes of SEQ ID No. 488 and 489. The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, *J. Mol. Biol.* 215: 403 (1990), the disclosure of which is incorporated herein by reference in its entirety), FASTA (Pearson and Lipman, *Proc. Natl. Acad. Sci. USA*, 85: 2444 (1988), the disclosure of which is incorporated herein by reference in its entirety), FASTDB (Brutlag et al. Comp. App. Biosci. 6:237–245, 1990, the disclosure of which is incorporated herein by reference in its entirety), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer Molecular Simulations Inc.), SeqFold (Molecular Simulations Inc.), the EMBL/Swissprotein database, the MDL Available Chemicals Directory database, the MDL Drug Data Report data base, the Comprehensive Medicinal Chemistry database, Derwents's World Drug Index database, the BioByteMasterFile database, the Genbank database, and the Genseqn database. Many other programs and data bases would be apparent to one of skill in the art given the present disclosure. Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

It should be noted that the nucleic acid codes of the invention further encompass all of the polynucleotides disclosed, described or claimed in the present invention. Also, it should be noted that the polypeptide codes of SEQ ID Nos. 488 and 489 further encompass all of the polypeptides disclosed, described or claimed in the present invention. Moreover, the present invention specifically contemplates the storage of such codes on computer readable media and computer systems individually or in combination, as well as the use of such codes and combinations in the methods of section "VI. Computer-Related Embodiments."

Throughout this application, various publications, patents, and published patent applications are cited. The disclosures of the publications, patents, and published patent specifications referenced in this application are hereby incorporated by reference into the present disclosure to more fully describe the state of the art to which this invention pertains.

VII. DNA Typing Methods and Systems

The present invention also encompasses a DNA typing system having a much higher discriminatory power than currently available typing systems. The systems and associated methods are particularly applicable in the identification of individuals for forensic science and paternity determinations. These applications have become increasingly important; in forensic science, for example, the identification of individuals by polymorphism analysis has become widely accepted by courts as evidence.

While forensic geneticists have developed many techniques to compare homologous segments of DNA to determine if the segments are identical or if they differ in one or more nucleotides, each technique still has certain disadvantages. In particular, the techniques vary widely in terms of expense of analysis, time required to carry out an analysis and statistical power.

RFLP Analysis Methods

The best known and most widespread method in forensic DNA typing is the restriction fragment length polymorphism (RFLP) analysis. In RFLP testing, a repetitive DNA sequence referred to as a variable number tandem repeat (VNTR) which varies between individuals is analyzed. The core repeat is typically a sequence of about 15 base pairs in length, and highly polymorphic VNTR loci can have an average of about 20 alleles. DNA restriction sites located on either site of the VNTR are exploited to create DNA fragments from about 0.5 Kb to less than 10 Kb which are then separated by electrophoresis, indicating the number of repeats found in the individual at the particular loci. RFLP methods generally consist of (1) extraction and isolation of DNA, (2) restriction endonuclease digestion; (3) separation of DNA fragments by electrophoresis; (4) capillary transfer; (5) hybridization with radiolabelled probes; (6) autoradiography; and (7) interpretation of results (Lee, H. C. et al., Am. J. Forensic. Med. Pathol. 15(4): 269–282 (1994)). RFLP methods generally combine analysis at about 5 loci and have much higher discriminate potential than other available test due the highly polymorphic nature of the VNTRs. However, autoradiography is costly and time consuming and an analysis generally takes weeks or months for turnaround. Additionally, a large amount of sample DNA is required, which is often not available at a crime scene. Furthermore, the reliability of the system and its credibility as evidence is decreased because the analysis of tightly spaced bands on electrophoresis results in a high rate of error.

PCR Methods

PCR based methods offer an alternative to RFLP methods. In a first method called AmpFLP, DNA fragments containing VNTRs are amplified and then separated electrophoretically, without the restriction step of RFLP method. While this method allows small quantities of sample DNA to be used, decreases analysis time by avoiding autoradiography, and retains high discriminatory potential, it nevertheless requires electrophoretic separation which takes substantial time and introduces an significant error rate. In another AmpFLP method, short tandem repeats (STRs) of 2 to 8 base pairs are analyzed. STRs are more suitable to analysis of degraded DNA samples since they require smaller amplified fragments but have the disadvantage of requiring separation of the amplified fragments. While STRs are far less informative than longer repeats, similar discriminatory potential can be achieved if enough STRs are used in a single analysis.

Other methods include sequencing of mitochondrial DNA, which is especially suitable for situations where sample DNA is very degraded or in small quantities. However, only a small region of 1 Kb of the mitochondrial DNA referred to as the D-Loop locus has been found useful for typing because of its polymorphic nature, resulting in lower discriminatory potential than with RFLP or AmpFLP methods. Furthermore, DNA sequencing is expensive to carry out on a large number of samples.

Further available methods include dot-blot methods, which involve using allele specific oligonucleotide probes which hybridize sequence specifically to one allele of a polymorphic site. Systems include the HLA DQ-alpha kit developed by Cetus Corp. which has a discriminatory value of about 1 in 20, and a dot-blot strip referred to as the Polymarker strip combining five genetic loci for a discriminatory value of about one in a few thousand. (Weedn, V., Clinics in Lab. Med. 16(1): 187–196 (1996)).

In addition to difficulties in analysis and time consuming laboratory procedures, it remains desirable for all DNA typing systems to have a higher discriminatory power. Several applications exist in which even the most discriminating tests need improvement in order to remove the considerable remaining doubt resulting from such analyses. Table 6 below lists characteristics of currently available forensic testing systems (Weedn, (1996)) and compares them with the method of the invention.

TABLE 6

| Test type | Technology | Turn-around time | Discriminatory potential | Sensitivity (amount DNA) | Sample |
|---|---|---|---|---|---|
| RFLP | VNTR (auto-radiography) | Weeks or months | $10^6$ to $10^9$ | 10 ng | Highly intact DNA |
| AmpFLP | VNTR (PCR based) | Days | $10^3$ to $10^6$ | 100 pg | Moderate degradation |
| Dot blot (ex. HLADQA1) | Sequence specific oligo-nucleotide probes | Days | $10^1$ to $10^3$ | 1 ng | Moderate degradation |
| Mito-chondrial DNA | D-loop sequence (PCR based) | Days | $10^2$ | 1 pg | Severe degradation |
| Present marker set | Biallelic Markers (set of 13, set of 100, set of 500) | Hours to Days (throughput dependent) | $10^6$, $10^{47}$, $10^{484}$ | 100 pg | Moderate degradation |

Applications

As described above, an important application of DNA typing tests is to determine whether a DNA sample (e.g. from a crime scene) originated from an individual suspected of leaving said DNA sample.

There are several applications for DNA typing which require a particularly powerful genotyping system. In a first application, a high powered typing system is advantageous when for example a suspect is identified by searching a DNA profile database such as that maintained by the U.S. Federal Bureau of Investigation. Since databases may contain large numbers of data entries that are expected to increase consistently, currently used forensic systems can be expected to identify several matching DNA profiles due to their relative lack of power. While database searches generally reinforce the evidence by excluding other possible suspects, low powered typing systems resulting in the identification of several individuals may often tend to diminish the overall case against a defendant.

In another application, a target population is systematically tested to identify an individual having the same DNA profile as that of a DNA sample. In such a situation, a defendant is chosen at random based on DNA profile from a large population of innocent individuals. Since the population tested can often be large enough that at least one positive match is identified, and it is usually not possible to exhaustively test a population, the usefulness of the evidence will depend on the level of significance of the forensic test. In order to render such an application useful as a sole or primary source of evidence, DNA typing systems of extremely high discriminatory potential are required.

In yet another application, it is desirable to be able to discriminate between related individuals. Because related individuals will be expected to share a large portion of alleles at polymorphic sites, a very high powered DNA typing assay would be required to discriminate between them. This can have important effects if a sample is found to match the defendant's DNA profile and no evidence that the perpetrator is a relative can be found.

Accordingly, there is a need in this art for a rapid, simple, inexpensive and accurate technique having a very high resolution value to determine relationships between individuals and differences in degree of relationships. Also, there is a need in the art for a very accurate genetic relationship test procedure which uses very small amounts of an original DNA sample, yet produces very accurate results.

The present invention thus involves methods for the identification of individuals comprising determining the identity of the nucleotides at set of genetic markers in a biological sample, wherein said set of genetic markers comprises at least one DME-related biallelic marker. The present invention provides an extensive set of biallelic markers allowing a higher discriminatory potential than the genetic markers used in current forensic typing systems. Also, biallelic markers can be genotyped in individuals with much higher efficiency and accuracy than the genetic markers used in current forensic typing systems. In preferred embodiments, the invention comprises determining the identity of a nucleotide at a DME-related biallelic marker by single nucleotide primer extension, which does not require electrophoresis as in techniques described above and results in lower rate of experimental error. As shown in Table 6, above, in comparison with PCR based VNTR based methods which allow discriminatory potential of thousands to millions, and RFLP based methods which allow discriminatory potential of merely millions to billions under optimal assumptions, the biallelic marker based method of the present invention provides a radical increase in discriminatory potential.

Any suitable set of genetic markers and biallelic markers of the invention may be used, and may be selected according to the discriminatory power desired. Biallelic markers, sets of biallelic markers, probes, primers, and methods for determining the identity of said biallelic markers are further described herein.

Discriminatory Potential of Biallelic Marker Typing

Calculating Discriminatory Potential

The discriminatory potential of the forensic test can be determined in terms of the profile frequency, also referred to as the random match probability, by applying the product rule. The product rule involves multiplying the allelic frequencies of all the individual alleles tested, and multiplying by an additional factor of 2 for each heterozygous locus.

In one example discussed below, the discriminatory potential of biallelic marker typing can be considered in the context of forensic science. In order to determine the discriminatory potential with respect to the numbers of biallelic markers to be used in a genetic typing system, the formulas and calculations below assume that (1) the population under study is sufficiently large (so that we can assume no consanguinity); (2) all markers chosen are not correlated, so that the product rule (Lander and Budlowle (1992)) can be applied; and (3) the ceiling rule can be applied or that the allelic frequencies of markers in the population under study are known with sufficient accuracy.

As noted in Weir, B. S., *Genetic data Analysis II: Methods for Discrete population genetic Data, Sinauer Assoc., Inc., Sunderland, Mass., USA,* 1996, the example assumes a crime has been committed and a sample of DNA from the perpetrator (P) is available for analysis. The genotype of this DNA sample can be determined for several genetic markers, and the profile A of the perpetrator can thereby be determined.

In this example, one suspect (S) is available for typing. The same set of genetic markers, such as the biallelic markers of the invention, are typed and the same profile A is obtained for (S) and (P). Two hypotheses are thus presented as follows:

(1) either S is P (event C)

(2) either S is not P (event $\overline{C}$).

The ratio L of both probabilities can then be calculated using the following equation:

$$L = \frac{pr(S = A, P = A / C)}{pr(S = A, P = A / \overline{C})}$$

L can then further be calculated by the following equation:

$$L = \frac{1}{pr(P = A / S = A, \overline{C})} \quad (1) \text{ Equation 1}$$

These probabilities as well as L can be calculated in several settings, notably for different kinship coefficients between P and S for a genetic marker (see Weir, (1996)).

Assuming that all genetic markers chosen are independent of each other, the global ratio L for a set of genetic markers will be the product over each genetic marker of all L.

It is further possible to estimate the mean number of biallelic markers or VNTRs required to have a ratio L equal to $10^8$ or $10^6$ by calculating the expectancy of the random variable L using the following equation:

$$E(L) = \prod_{i=1}^{N} E(L_i) \text{ where } N \text{ is the number of loci}$$

$$E(L_i) = \sum_{j=1}^{G_i} pr(P = A_{ij} / S = A_{ij}, \overline{C}) \cdot L_{ij},$$

where $A_{ij}$ is the genotype at the ith marker, $L_{ij}$ the ratio associated with such genotype, $G_i$ being the number of genotypes at locus i. From equation 1, it can easily be derived that the expectancy of $L_i$ is $G_i$, the number of possible genotypes of this marker.

The general expectancy for a set of genetic markers can then be expressed by the following equation:

$$E(L) = \prod_{i=1}^{N} G_i \quad (2) \text{ Equation 2}$$

Biallelic Marker-based DNA Typing Systems

Using the equations described above, it is possible to select biallelic marker-based DNA typing systems having a desired discriminatory potential.

Using biallelic markers, E(L) can thus be expressed as $3^N$. When using VNTR-based DNA typing systems, assuming the VNTRs have 10 alleles, E(L) can be expressed as $55^N$, Based on these results, the number of biallelic markers or VNTRs needed to obtain, in mean, a ratio of at least $10^6$ or $10^8$ can calculated, and are set forth below in Table 7.

TABLE 7

| Marker sets | L = $10^6$ | L = $10^8$ |
| --- | --- | --- |
| Biallelic | 13 | 17 |
| 5-allele markers (e.g. VNTR) | 5 | 7 |
| 10-allele markers (e.g. VNTR) | 4 | 5 |

Thus, in a first embodiment, DNA typing systems and methods of the invention may comprise genotyping a set of at least 13 or at least 17 biallelic markers to obtain a ratio of at least $10^6$ or $10^8$, assuming a flat distribution of L across the biallelic markers. In preferred embodiments, a greater number of biallelic markers is genotyped to obtain a higher L value. Preferably at least 1, 2, 3, 4, 5, 10, 13, 15, 17, 20, 25, 30, 40, 50, 70, 85, 100, 150, or all of the DME-related biallelic markers are genotyped. Said DNA typing systems of the invention would result in L values as listed in Table 8 below as an indication of the discriminate potential of the systems of the invention.

TABLE 8

| Number of Biallelic Markers | L |
| --- | --- |
| 50 | 7.2 * $10^{23}$ |
| 100 | 5 * $10^{47}$ |
| 484 | $3^{484}$ |

In situations where the distribution of L is not flat, such as in the worst case when the perpetrator is homozygous for the major allele at each genetic locus and L thus takes the lowest value, a larger number of biallelic markers is required for the same discriminatory potential. Therefore, in preferred embodiments, DNA typing systems and methods of the invention using a larger number of biallelic markers allow for uneven distributions of L across the biallelic markers. For example, assuming unrelated individuals, a set of independent markers having an allelic frequency of 0.1/0.9, and the genetic profile of a homozygote at each genetic loci for the major allele, 66 biallelic markers are required to obtain a ratio of $10^6$, and 88 biallelic markers are required to obtain a ratio of $10^8$. Thus, in preferred embodiments based on the use of markers having a major allele of sufficiently high frequency, this is a first estimation of the upper bound of markers required in a DNA typing system.

In further embodiments, it is also desirable to have the ability to discriminate between relatives. Although unrelated individuals have a low probability of sharing genetic profiles, the probability is greatly increased for relatives. For example, the DNA profile of a suspect matches the DNA profile of a sample at a crime scene, and the probability of obtaining the same DNA profile if left by an untyped relative is required. Table 9 below (Weir (1996)) lists probabilities for several different types of relationships, assuming alleles $A_i$ and $A_j$, and population frequencies $p_i$ and $p_j$, and lists likelihood ratios assuming genetic loci having allele frequencies of 0.1.

TABLE 9

| Genotype | Relationship | Pr(p = A|S = A) | L |
| --- | --- | --- | --- |
| $A_i A_j$ | Full brothers | $(1 + p_i + p_j + 2p_i p_j)/4$ | 3.3 |
| | Father and son | $(p_i + p_j)/2$ | 10.0 |
| | Half brothers | $(p_i + p_j + 4p_i p_j)/4$ | 16.7 |
| | Uncle and nephew | $(1 + p_i + p_j + 2p_i p_j)/4$ | 16.7 |

TABLE 9-continued

| Genotype | Relationship | Pr(p = A|S = A) | L |
| --- | --- | --- | --- |
| | First cousins | $(1 + p_i + p_j + 12p_i p_j)/8$ | 25.0 |
| | Unrelated | $2p_i p_j$ | 50.0 |
| $A_i A_j$ | Full brothers | $(1 + p_i)^2/4$ | 3.3 |
| | Father and son | $p_i$ | 10.0 |
| | Half brothers | $p_i (1 + p_i)/2$ | 18.2 |
| | Uncle and nephew | $p_i (1 + p_i)/2$ | 18.2 |
| | First cousins | $p_i (1 + 3p_i)/4$ | 30.8 |
| | Unrelated | $p_i^2$ | 100.0 |

In one example, where the suspect is the full brother of the perpetrator, the number of required biallelic markers will be 187 assuming the profile is that of a homozygote for the major allele at each biallelic marker.

In yet further embodiments, the DNA typing systems and methods of the present invention may further take into account effects of subpopulations on the discriminatory potential. In embodiments described above for example, DNA typing systems consider close familial relationships, but do not take into account membership in the same population. While population membership is expected to have little effect, the invention may further comprise genotyping a larger set of biallelic markers to achieve higher discriminatory potential. Alternatively, a larger set of biallelic markers may be optimized for typing selected populations; alternatively, the ceiling principle may be used to study allele frequencies from individuals in various populations of interest, taking for any particular genotype the maximum allele frequency found among the populations.

The invention thus encompasses methods for genotyping comprising determining the identity of a nucleotide at least 13, 15, 17, 20, 25, 30, 40, 50, 66, 70, 85, 88, 100, 187, 200, 300, 500, 700, 1000 or 2000 biallelic markers in a biological sample, wherein at least 1, 2, 3, 4, 5, 10, 13, 17, 20, 25, 30, 40, 50, 70, 85, 100, 150, 200, 300, 400 or all of said biallelic markers are DME-related biallelic markers selected from the group consisting of SEQ ID Nos. 485–487, 494–531, 533–547, 549–846, 848–956, 958–977.

Any markers known in the art may be used with the DME-related biallelic markers of the present invention in the DNA typing methods and systems described herein, for example in anyone of the following web sites offering collections of SNPs and information about those SNPs:

The Genetic Annotation Initiative (web site: cgap.nci.nih.gov/GAI/). An NIH run site which contains information on candidate SNPs thought to be related to cancer and tumorigenesis generally.

dbSNP Polymorphism Repository (world wide web site: ncbi.nlm.nih.gov/SNP/). A more comprehensive NIH-run database containing information on SNPs with broad applicability in biomedical research.

HUGO Mutation Database Initiative (web site: ariel.ucs.unimelb.edu.au:80/~cotton/mdi.htm). A database meant to provide systematic access to information about human mutations including SNPs. This site is maintained by the Human Genome Organisation (HUGO).

Human SNP Database (world wide web site: -genome.wi.mit.edu/SNP/human/index.html). Managed by the Whitehead Institute for Biomedical Research Genome Institute, this site contains information about SNPs resulting from the many Whitehead research projects on mapping and sequencing.

SNPs in the Human-Genome SNP database (world wide web site: ibc.wustl.edu/SNP). This website provides access to SNPs that have been organized by chromosomes and cytogenetic location. The site is run by Washington University.

HGBase (web site: hgbase.cgr.ke.se/). HGBASE is an attempt to summarize all known sequence variations in the human genome, to facilitate research into how genotypes affect common diseases, drug responses, and other complex phenotypes, and is run by the Karolinska Institute of Sweden.

The SNP Consortium Database (web site: snp.cshl.org/db/snp/map). A collection of SNPs and related information resulting from the collaborative effort of a number of large pharmaceutical and information processing companies.

GeneSNPs (world wide web site: genome.utah.edu/genesnps/). Run by the University of Utah, this site contains information about SNPs resulting from the U.S. National Institute of Environmental Health's initiative to understand the relationship between genetic variation and response to environmental stimuli and xenobiotics.

In addition, biallelic markers provided in the following patents and patent applications may also be used with the map-realted biallelic markers of the invention in the DNA typing methods and systems described above: U.S. Serial No. 60/206,615, filed Mar. 24, 2000; U.S. Serial No. 60/216,745, filed Jun. 30, 2000; WIPO Serial No. PCT/IB00/00184, filed Feb. 11, 2000; WIPO Serial No. PCT/IB98/01193, filed Jul. 17, 1998; PCT Publication No. WO 99/54500, filed Apr. 21, 1999; and WIPO Serial No. PCT/IB00/00403, filed Mar. 24, 2000.

Biallelic markers, sets of biallelic markers, probes, primers, and methods for determining the identity of a nucleotide at said biallelic markers are also encompassed and are further described herein, and may encompass any further limitation described in this disclosure, alone or in any combination.

Forensic matching by microsequencing is further described in Example 7 below.

EXAMPLES

Several of the methods of the present invention are described in the following examples, which are offered by way of illustration and not by way of limitation. Many other modifications and variations of the invention as herein set forth can be made without departing from the spirit and scope thereof and therefore only such limitations should be imposed as are indicated by the appended claims.

Example 1

De Novo Identification of Biallelic Markers

The biallelic markers set forth in this application were isolated from human genomic sequences. To identify biallelic markers, genomic fragments were amplified, sequenced and compared in a plurality of individuals.

DNA Samples

Donors were unrelated and healthy. They represented a sufficiently diverse group for being representative of a French heterogeneous population. The DNA from 100 individuals was extracted and tested for the de novo identification of biallelic markers.

DNA samples were prepared from peripheral venous blood as follows. Thirty ml of peripheral venous blood were taken from each donor in the presence of EDTA. Cells (pellet) were collected after centrifugation for 10 minutes at 2000 rpm. Red cells were lysed in a lysis solution (50 ml final volume: 10 mM Tris pH7.6; 5 mM $MgCl_2$; 10 mM NaCl). The solution was centrifuged (10 minutes, 2000 rpm) as many times as necessary to eliminate the residual red cells present in the supernatant, after resuspension of the pellet in the lysis solution. The pellet of white cells was lysed overnight at 42° C. with 3.7 ml of lysis solution composed of: (a) 3 ml TE 10-2 (Tris-HCl 10 mM, EDTA 2 mM)/NaCl 0.4 M; (b) 200 μl SDS 10%; and (c) 500 μl proteinase K (2 mg proteinase K in TE 10-2/NaCl 0.4 M).

For the extraction of proteins, 1 ml saturated NaCl (6M) (1/3.5 v/v) was added. After vigorous agitation, the solution was centrifuged for 20 minutes at 10000 rpm. For the precipitation of DNA, 2 to 3 volumes of 100% ethanol were added to the previous supernatant, and the solution was centrifuged for 30 minutes at 2000 rpm. The DNA solution was rinsed three times with 70% ethanol to eliminate salts, and centrifuged for 20 minutes at 2000 rpm. The pellet was dried at 37° C., and resuspended in 1 ml TE 10-1 or 1 ml water. The DNA concentration was evaluated by measuring the OD at 260 nm (1 unit OD=50 μg/ml DNA). To determine the presence of proteins in the DNA solution, the OD 260/OD 280 ratio was determined. Only DNA preparations having a OD 260/OD 280 ratio between 1.8 and 2 were used in the subsequent examples described below. DNA pools were constituted by mixing equivalent quantities of DNA from each individual.

Amplification of Genomic DNA by PCR

Amplification of specific genomic sequences was carried out on pooled DNA samples obtained as described above.

Amplification Primers

The primers used for the amplification of human genomic DNA fragments were defined with the OSP software (Hillier & Green, 1991). Preferably, primers included, upstream of the specific bases targeted for amplification, a common oligonucleotide tail useful for sequencing. Primers PU contain the following additional PU 5' sequence: TGTAAAACGACGGCCAGT; primers RP contain the following RP 5' sequence: CAGGAAACAGCTATGACC. Primers are listed in Table 17.

Amplification

PCR Assays Were Performed Using the Following Protocol

| Final volume | 25 μl |
|---|---|
| DNA | 2 ng/μl |
| $MgCl_2$ | 2 mM |
| dNTP (each) | 200 μM |
| primer (each) | 2.9 ng/μl |
| Ampli Taq Gold DNA polymerase | 0.05 unit/μl |
| PCR buffer (10x = 0.1 M TrisHCl pH 8.3 0.5 M KCl) | 1x |

DNA amplification was performed on a Genius II thermocycler. After heating at 94° C. for 10 min, 40 cycles were performed. Cycling times and temperatures were: 30 sec at 94° C., 55° C. for 1 min and 30 sec at 72° C. Holding for 7 min at 72° C. allowed final elongation. The quantities of the amplification products obtained were determined on 96-well microtiter plates, using a fluorometer and Picogreen as intercalant agent (Molecular Probes).

Sequencing of Amplified Genomic DNA and Identification of Biallelic Polymorphisms Sequencing of the amplified DNA was carried out on ABI 377 sequencers. The sequences of the amplification products were determined using automated dideoxy terminator sequencing reactions with a dye terminator cycle sequencing protocol. The products of the sequencing reactions were run on sequencing gels and the sequences were determined using gel image analysis (ABI Prism DNA Sequencing Analysis software 2.1.2 version).

The sequence data were further evaluated to detect the presence of biallelic markers within the amplified fragments. The polymorphism search was based on the presence of superimposed peaks in the electrophoresis pattern resulting from different bases occurring at the same position. However, the presence of two peaks can be an artifact due to background noise. To exclude such an artifact, the two DNA strands were sequenced and a comparison between the two strands was carried out. In order to be registered as a polymorphic sequence, the polymorphism had to be detected on both strands. Further, some biallelic single nucleotide polymorphisms were confirmed by microsequencing as described below.

Biallelic markers were identified in the analyzed fragments and are shown in Table 11(A–B) and Table 3(A–D).

Example 2

Genotyping of Biallelic Markers

The biallelic markers identified as described above were further confirmed and their respective frequencies were determined through microsequencing. Microsequencing was carried out on individual DNA samples obtained as described herein.

Microsequencing Primers

Amplification of genomic DNA fragments from individual DNA samples was performed as described in Example 1 using the same set of PCR primers (See Table 17). Microsequencing was carried out on the amplified fragments using specific primers (See Table 16). The preferred primers used in microsequencing had about 19 nucleotides in length and hybridized just upstream of the considered polymorphic base.

The microsequencing reactions were performed as follows: 5 µl of PCR products were added to 5 µl purification mix (2U SAP (Shrimp alkaline phosphate) (Amersham E70092X)); 2U Exonuclease I (Amersham E70073Z); and 1 µl SAP buffer (200 mM Tris-HCl pH8, 100 mM $MgCl_2$) in a microtiter plate. The reaction mixture was incubated 30 minutes at 37° C., and denatured 10 minutes at 94° C. afterwards. To each well was then added 20 µl of microsequencing reaction mixture containing: 10 pmol microsequencing oligonucleotide (19 mers, GENSET, crude synthesis, 5 OD), 1 U Thermosequenase (Amersham E79000G), 1.25 µl Thermosequenase buffer (260 mM Tris HCl pH 9.5, 65 mM $MgCl_2$), and the two appropriate fluorescent ddNTPs complementary to the nucleotides at the polymorphic site corresponding to both polymorphic bases (11.25 nM TAMRA-ddTTP; 16.25 nM ROX-ddCTP; 1.675 nM REG-ddATP; 1.25 nM RHO-ddGTP ; Perkin Elmer, Dye Terminator Set 401095). After 4 minutes at 94° C., 20 PCR cycles of 15 sec at 55° C., 5 sec at 72° C., and 10 sec at 94° C. were carried out in a Tetrad PTC-225 thermocycler (MJ Research). The microtiter plate was centrifuged 10 sec at 1500 rpm. The unincorporated dye terminators were removed by precipitation with 19 µl $MgCl_2$ 2 mM and 55 µl 100% ethanol. After 15 minute incubation at room temperature, the microtiter plate was centrifuged at 3300 rpm 15 minutes at 4° C. After discarding the supernatants, the microplate was evaporated to dryness under reduced pressure (Speed Vac). Samples were resuspended in 2.5 µl formamide EDTA loading buffer and heated for 2 min at 95° C. 0.8 µl microsequencing reaction were loaded on a 10% (19:1) polyacrylamide sequencing gel. The data were collected by an ABI PRISM 377 DNA sequencer and processed using the GENESCAN software (Perkin Elmer).

Frequency of Biallelic Markers

Frequencies are reported for the less common allele only and are shown in Table 11(A–B). The frequencies for both alleles are shown for preferred MGST-II, ME1, UGT1A7 and UGT2B4 markers in Tables 19, 20, 21 and 22, respectively.

Example 3

Association Between Asthma and the Biallelic Markers of the MGST-II Gene

Collection of DNA Samples from Trait Positive and Control Individuals

The disease trait followed in this association study was asthma, a disease involving the leukotriene pathway. The asthmatic population corresponded to 298 individuals that took part in a clinical study for the evaluation of the anti-asthmatic drug zileuton. More than 90% of these 297 asthmatic individuals had a Caucasian ethnic background. The control population corresponded to 178 individuals from a random US Caucasian population.

Genotyping of Affected and Control Individuals

The general strategy to perform the association studies was to individually scan the DNA samples from all individuals in each of the populations described above in order to establish the allele frequencies of the above described biallelic markers in each of these populations.

Allelic frequencies of the above-described biallelic marker alleles in each population were determined by performing microsequencing reactions on amplified fragments obtained by genomic PCR performed on the DNA samples from each individual. Genomic PCR and microsequencing were performed as detailed above in Examples 1 and 2 using the described PCR and microsequencing primers.

Haplotype Frequency Analysis

None of the single marker alleles showed a significant association with asthma however, significant results were obtained in haplotype studies. Allelic frequencies were useful to check that the markers used in the haplotype studies meet the Hardy-Weinberg proportions (random mating).

The results of the haplotype analysis using 13 biallelic markers (12-421-135, 12-421-140, 12-430-80, 12-441-233, 12-442-133, 12-447-58, 12-455-326, 12-461-299, 12-453-429, 12-424-198, 12-454-363, 12-458-196 and 12-426-154) are shown in Table 23. Haplotype an for association of MGST-II biallelic markers and asthma was performed by estimating the frequencies of all possible 2, 3 and 4 marker haplotypes in the asthmatic and control populations described above. Haplotype estimations were performed by applying the Expectation-Maximization (EM) algorithm (Excoffier and Slatkin, Mol. Biol. Evol., 12:921–927, 1995), using the EM-HAPLO program (Hawley et al., Am. J. Phys. Anthropol.,1 8:104, 1994) as described above. Estimated haplotype frequencies in the asthmatic and control population were compared by means of a chi-square statistical test (one degree of freedom).

Table 23 shows the most significant haplotypes obtained. Haplotype No. 6 consisting of three biallelic markers (12-455-326, 12-453-429 and 12-424-198) had a p-value of $3.2\mathrm{e}10^{-5}$ and an odds ratio of 12.22. Estimated haplotype frequencies were 11.8% in the cases and 1.1% in the controls. Haplotype No. 18 consisting of four biallelic markers (12-455-326, 12-453-429, 12-424-198 and 12-454-363) had a p-value of $1.2\mathrm{el}10^{-6}$ and an odds ratio of 100.00. Both haplotypes are related as three out of four biallelic marker alleles (G at 12-455-326, C at 12-453-429 and T and 12-454-363) are common to both haplotypes. Haplotype No. 19 consisting of four biallelic markers (12-447-58, 12-455-326, 12-461-299 and 12-453-429) had a p-value of $8.2\mathrm{e}10^{-6}$ and an odds ratio of 100.00. Markers 12-455-326 and 12-453-429 are common in all three significant haplotypes; therefore, they represent preferred markers for the diagnosis of asthma. Haplotypes Nos. 6, 18 and 19 are strongly associated with asthma. Haplotypes Nos. 7–17 and 20–30 also showed very significant association (see Table 23).

The statistical significance of the results obtained for the haplotype analysis was evaluated by a phenotypic permutation test reiterated 1000 or 10,000. For this computer simulation, data from the asthmatic and control individuals were pooled and randomly allocated to two groups which contained the same number of individuals as the case-control populations used to produce the data summarized in Table 23. A haplotype analysis was then run on these artificial groups for the 3 markers included in haplotype No. 6 (haplotype GCT), the 4 markers included in haplotype No. 18 (haplotype GCTG) and the 4 markers included in haplotype No. 19 (haplotype CATT), all of which showed a strong association with asthma. This experiment was reiterated 1000 and 10,000 times and the results are shown in Table 24. These results demonstrate that among 1000 iterations only 3 and among 10,000 iterations only 31 of the obtained haplotypes had a p-value comparable to the one obtained for haplotype No. 6 (haplotype GCT). These results demonstrate that among 1000 iterations 0 and among 10,000 iterations only 5 of the obtained haplotypes had a p-value comparable to the one obtained for haplotype No. 18 (haplotype GCTG). These results further demonstrate that among 1000 iterations only 12 and among 10,000 iterations only 76 of the obtained haplotypes had a p-value comparable to the one obtained for haplotype No. 19 (haplotype CATT). These results clearly validate the statistical significance of the association between the haplotypes shown in Table 23 and asthma.

Example 4

Association Between Side Effects Upon Treatment With the Anti-Asthmatic Drug Zileuton (Zyflo™) and the Biallelic Markers of the Invention Collection of DNA Samples From Trait Positive and Control Individuals The side effect examined in this study was the hepatotoxicity experienced by asthmatic individuals as a result of their treatment with Zileuton as part of a clinical study. Asthmatic individuals were unrelated and more than 90% of the individuals had a Caucasian ethnic background. Hepatotoxicity was monitored by measuring the serum levels of alanine aminotransferase (ALT), which is a sensitive indicator of liver cell damage.

More than 90% of the asthmatic individuals participating in this study did not experience Zileuton-associated ALT increase compared to their ALT levels prior to zileuton intake. As mentioned above, an association study is more informative if the populations considered present extreme phenotypes. Therefore, the asthmatic individuals, which were selected for the side effect positive trait (ALT+), corresponded to 89 individuals that presented at least 3 times the upper limit of normal (ULN) level of ALT. On the other side, the asthmatic individuals that were selected for the side effect negative trait (ALT–) corresponded to 208 individuals that presented less than 1×ULN of ALT. ALT+ and ALT– populations corresponded to 4% and 35% respectively of the total asthmatic individuals that participated in this study.

Genotyping of Affected and Control Individuals

The general strategy to perform the Association studies was to individually scan the DNA samples from all individuals in each of the populations described above in order to establish the allele frequencies of the above described biallelic markers in each of these populations.

Allelic frequencies of the above-described biallelic marker alleles in each population were determined by performing microsequencing reactions on amplified fragments obtained by genomic PCR performed on the DNA samples from each individual. Genomic PCR and microsequencing were performed as detailed above in Examples 1 and 2 using the described PCR and microsequencing primers.

Allelic Frequency Analysis

None of the single marker alleles showed a significant association with hepatotoxicity to zileuton however, significant results were obtained in haplotype studies. See Tables 25, 28, and 31 for the allelic frequency analysis of MGST-II, UGT1A7, and UGT2B4, respectively.

Haplotype Frequency Analysis of the MGST-II-Related Biallelic Markers

The results of the haplotype analysis using 13 MGST-II-related biallelic markers (12-421-135, 12-421-140, 12-430-80, 12-441-233, 12-442-133, 12-447-58, 12-455-326, 12-461-299, 12-453-429, 12-424-198, 12-454-363, 12-458-196 and 12-426-154) are shown in Table 26. Haplotype analysis for association of MGST-II biallelic markers and asthma was performed by estimating the frequencies of all possible 2, 3 and 4 marker haplotypes in the ALT+ and ALT– populations described above. Haplotype estimations were performed by applying the Expectation-Maximization (EM) algorithm (Excoffier and Slatkin, *Mol. Biol. Evol.*, 12:921–927, 1995), using the EM-HAPLO program (Hawley et al., *Am. J. Phys. Anthropol.*,18:104, 1994) as described above. Estimated haplotype frequencies in the ALT+ and ALT– populations were compared by means of a chi-square statistical test (one degree of freedom).

Table 26 shows the most significant haplotypes obtained. Haplotype No. 6 consisting of three biallelic markers (12-441-233, 12-461-299 and 12-453-429) presented a p-value of $1.5 \cdot 10^{-5}$ and an odd-ratio of 3.63. Estimated haplotype frequencies were 15.7% in the cases and 4.9% in the controls. Haplotype No. 19 consisting of four biallelic markers (12-441-233, 12-461-299, 12-453-429 and 12-426-154) had a p-value of $5.2 \cdot 10^{-7}$ and an odd ratio of 5.75. Estimated haplotype frequencies were 14.1% in the cases and 2.8% in the controls. Both haplotypes showed strong association with elevated serum ALT level upon treatment with zileuton. Both haplotypes are related as three out of four biallelic marker alleles (C at 12-441-233, T at 12-461-299 and T at 12-453-429) are common to both haplotypes. Haplotypes Nos. 7–18 and 20–31 of Table 25 also showed very significant association.

The statistical significance of the results obtained for the haplotype analysis was evaluated by a phenotypic permutation test reiterated 1000 or 10,000 times on a computer. For this computer simulation, data from the ALT+ and ALT– populations were pooled and randomly allocated to two groups which contained the same number of individuals as the ALT+ and ALT– populations used to produce the data summarized in Table 26. A haplotype analysis was then run on these artificial groups for the 3 markers included in haplotype No. 6 (haplotype CTT) and for the 4 markers included in haplotype No. 19 (haplotype CTTA) which, showed the strongest association with secondary effects to zileuton. This experiment was reiterated 1000 and 10,000 times and the results are shown in Table 27. These results demonstrate that among 1000 iterations only 1 and among 10,000 iterations only 12 of the obtained haplotypes had a p-value comparable to the one obtained for haplotype No. 6 (haplotype CTT). These results further demonstrate that among 1000 iterations only 1 and among 10,000 iterations only 7 of the obtained haplotypes had a p-value comparable to the one obtained for haplotype No. 19 (haplotype CTTA). These results clearly validate the statistical significance of the association between hepatotoxicity to Zyflo™ and the haplotypes shown in Table 26.

Haplotype Frequency Analysis of the UGT1A7-Related Biallelic Markers

The results of the haplotype analysis using 7 UGT1A7-related biallelic markers (12-121-326, 12-128-225, 12-148-311, 12-156-91, 12-139-380, 12-140-134, 12-142-321) are shown in Table 29. Haplotype analysis for association of UGT1A7 biallelic markers and asthma was performed by estimating the frequencies of all possible 2, 3 and 4 marker haplotypes in the ALT+ and ALT− populations described above. Haplotype estimations were performed by applying the Expectation-Maximization (EM) algorithm (Excoffier and Slatkin, *Mol. Biol. Evol.,* 12:921–927, 1995), using the EM-HAPLO program (Hawley et al., *Am. J. Phys. Anthropol.,*18:104, 1994) as described above. Estimated haplotype frequencies in the ALT+ and ALT− populations were compared by means of a chi-square statistical test (one degree of freedom).

Table 29 shows the most significant haplotypes obtained. Haplotype No. 8 consisting of three biallelic markers (12-121-326, 12-156-91 and 12-142-321) presented a p-value of $7.0 \; 10^{-4}$ and an odd-ratio of 2.98. Estimated haplotype frequencies were 14.1% in the cases and 5.2% in the controls. Haplotype No. 12 consisting of four biallelic markers (12-128-225, 12-156-91, 12-139-380, 12-140-134) had a p-value of $7.7 \; 10^{-3}$ and an odd ratio of 1.85. Estimated haplotype frequencies were 27.4% in the cases and 17.0% in the controls.

The statistical significance of the results obtained for the haplotype analysis was evaluated by a phenotypic permutation test reiterated 1000 or 10,000 times on a computer. For this computer simulation, data from the ALT+ and ALT− populations were pooled and randomly allocated to two groups which contained the same number of individuals as the ALT+ and ALT− populations used to produce the data summarized in Table 29. A haplotype analysis was then run on these artificial groups for the 4 markers included in haplotype No. 12 (haplotype AAGT), which showed the strongest association with secondary effects to zileuton. This experiment was reiterated 1000 and 10,000 times and the results are shown in Table 30.

Haplotype Frequency Analysis of the UGT2B4-Related Biallelic Markers

The results of the haplotype analysis using 8 UGT2B4-related biallelic markers (12-653-423, 10-470-25, 10-471-84, 10-471-85, 12-637-219, 12-639-95, 12-652-203, 12-462-417) are shown in Table 32. Haplotype analysis for association of UGT2B4 biallelic markers and asthma was performed by estimating the frequencies of all possible 2, 3 and 4 marker haplotypes in the ALT+ and ALT− populations described above. Haplotype estimations were performed by applying the Expectation-Maximization (EM) algorithm (Excoffier and Slatkin, *Mol. Biol. Evol.,* 12:921–927, 1995), using the EM-HAPLO program (Hawley et al., *Am. J. Phys. Anthropol.,*18:104, 1994) as described above. Estimated haplotype frequencies in the ALT+ and ALT− populations were compared by means of a chi-square statistical test (one degree of freedom).

Table 32 shows the most significant haplotypes obtained. Haplotype No. 1 consisting of two biallelic markers (10-470-25 and 12-652-203) presented a p-value of $3.8 \; 10^{-3}$ and an odd-ratio of 1.83. Estimated haplotype frequencies were 30.3% in the cases and 19.2% in the controls. Haplotype No. 35 consisting of four biallelic markers (12-653-423, 10-470-25, 12-639-95, 12-652-203) had a p-value of $1.8 \; 10^{-4}$ and an odd ratio of 2.45. Estimated haplotype frequencies were 25.5% in the cases and 12.3% in the controls.

The statistical significance of the results obtained for the haplotype analysis was evaluated by a phenotypic permutation test reiterated 1000 or 10,000 times on a computer. For this computer simulation, data from the ALT+ and ALT− populations were pooled and randomly allocated to two groups which contained the same number of individuals as the ALT+ and ALT− populations used to produce the data summarized in Table 32. A haplotype analysis was then run on these artificial groups for the 2 markers included in haplotype No. 1 (haplotype TC), which showed the strongest association with secondary effects to zileuton. This experiment was reiterated 1000 and 10,000 times and the results are shown in Table 33.

Example 5

Identification of Mutations and of Low Frequency Alleles of the MGST-II Gene

Exons 3–5, the 5'UTR region and the 3'region of the MGST-II gene were screened for mutations by comparing their sequence in individuals exhibiting elevated ALT levels upon treatment with zileuton (ALT+) and in individuals showing normal ALT levels upon treatment with zileuton (ALT−). ALT+ and ALT− individuals are further described in Example 4. Intron sequences immediately flanking the exons were also screened.

To identify mutations, fragments of the MGST-II gene were amplified, sequenced and compared in ALT+ and ALT− individuals. DNA samples from each individual were processed separately.

DNA Samples

Individual DNA samples were obtained as described in Example 1.

Amplification of the MGST-II Gene

Amplification primers are described in Table 17 and PCR assays were performed as described in Example 1.

Sequencing of Amplified Genomic DNA: Identification of Mutations and of Low Frequency Polymorphisms Sequencing of the amplified DNA was carried out on ABI 377 sequencers. The sequences of the amplification products were determined using automated dideoxy terminator sequencing reactions with a dye terminator cycle sequencing protocol. The products of the sequencing reactions were run on sequencing gels and the sequences were determined using gel image analysis (ABI Prism DNA Sequencing Analysis software 2.1.2 version).

The sequence data was further analyzed to detect the presence of mutations and of low frequency alleles. The sequences obtained with 79 ALT+ individuals and 105 ALT− individuals were compared. New polymorphisms/mutations were detected and the genotype of each individual for these markers was determined. Results are shown below:

TABLE 10

| Marker ID | Position in MGST-II gene | Least common allele/ mutation | Original allele | Genotype of ALT+ and ALT− individuals |
|---|---|---|---|---|
| 10-286-289 | 5'UTR | G | C | 79 ALT + C/C |
| | | | | 104 ALT − C/C |
| | | | | 1 ALT − GC |
| 10-286-345 | 5'UTR | T | A | 65 ALT + A/A |
| | | | | 12 ALT + A/T |
| | | | | 2 ALT + T/T |
| | | | | 82 ALT − A/A |
| | | | | 19 ALT − A/T |
| | | | | 3 ALT − T/T |
| 10-286-375 | 5'UTR | G | A | 78 ALT + A/A |
| | | | | 1 ALT + A/G |
| | | | | 104 ALT − A/A |

TABLE 10-continued

| Marker ID | Position in MGST-II gene | Least common allele/ mutation | Original allele | Genotype of ALT+ and ALT– individuals |
|---|---|---|---|---|
| 10-523-232 | Exon 3 | T | C | 75 ALT + C/C<br>100 ALT – C/C<br>1 ALT – C/T |
| 10-289-201 | Exon 4 | C | T | 76 ALT + T/T<br>2 ALT + C/T<br>100 ALT – T/T<br>1 ALT – C/T |
| 10-290-37 | Exon 5 | T | C | 78 ALT + C/C<br>1 ALT + C/T<br>104 ALT – C/C |
| 10-290-326 | 3'region | A | G | 79 ALT + G/G<br>103 ALT – G/G<br>1 ALT – A/G |
| 10-290-328 | 3'region | deletion | — | 1 ALT + deletion<br>78 ALT + —<br>104 ALT – — |

Eight polymorphisms were identified in the region of the MGST-II gene that was scanned. Three mutations were identified in the 3'UTR region. One mutation in exon 4 causes an amino acid substitution (Tyr→His) at the polypeptide level. A mutation in exon 5 introduces a stop codon into the ORF leading to the expression of a truncated MGST-II polypeptide. These mutations modify the specificity, activity and function of the MGST-II enzyme and therefore represent functional mutations of the MGST-II gene.

Example 6

Preparation of Antibody Compositions to MGST-II Variants

Preferably antibody compositions, specifically binding the 93-His variant or the SEQ ID No. 489 variant of MGST-II, are prepared.

Substantially pure protein or polypeptide is isolated from transfected or transformed cells containing an expression vector encoding the MGST-II protein or a portion thereof. The concentration of protein in the final preparation is adjusted, for example, by concentration on an Amicon filter device, to the level of a few micrograms per ml. Monoclonal or polyclonal antibodies to the protein can then be prepared as follows:

Monoclonal Antibody Production by Hybridoma Fusion

Monoclonal antibody to epitopes in the MGST-II protein or a portion thereof can be prepared from murine hybridomas according to the classical method of Kobler and Milstein (*Nature*, 256:495, 1975) or derivative methods thereof (see Harlow and Lane, *Antibodies A Laboratory Manual*, Cold Spring Harbor Laboratory, pp. 53–242, 1988).

Briefly, a mouse is repetitively inoculated with a few micrograms of the MGST-II protein or a portion thereof over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as ELISA, as originally described by Engvall, E., Meth. Enzymol. 70:419 (1980), and derivative methods thereof. Selected positive clones can be expanded and their monoclonal antibody product harvested for use. Detailed procedures for monoclonal antibody production are described in Davis, L. et al. Basic Methods in Molecular Biology Elsevier, New York. Section 21-2.

Polyclonal Antibody Production by Immunization

Polyclonal antiserum containing antibodies to heterogeneous epitopes in the MGST-II protein or a portion thereof can be prepared by immunizing suitable non-human animal with the MGST-II protein or a portion thereof, which can be unmodified or modified to enhance immunogenicity. A suitable non-human animal is preferably a non-human mammal is selected, usually a mouse, rat, rabbit, goat, or horse. Alternatively, a crude preparation which, has been enriched for MGST-II concentration can be used to generate antibodies. Such proteins, fragments or preparations are introduced into the non-human mammal in the presence of an appropriate adjuvant (e.g. aluminum hydroxide, RIBI, etc.) which is known in the art. In addition the protein, fragment or preparation can be pretreated with an agent which will increase antigenicity, such agents are known in the art and include, for example, methylated bovine serum albumin (mBSA), bovine serum albumin (BSA), Hepatitis B surface antigen, and keyhole limpet hemocyanin (KLH). Serum from the immunized animal is collected, treated and tested according to known procedures. If the serum contains polyclonal antibodies to undesired epitopes, the polyclonal antibodies can be purified by immunoaffinity chromatography.

Effective polyclonal antibody production is affected by many factors related both to the antigen and the host species. Also, host animals vary in response to site of inoculations and dose, with both inadequate or excessive doses of antigen resulting in low titer antisera. Small doses (ng level) of antigen administered at multiple intradermal sites appears to be most reliable. Techniques for producing and processing polyclonal antisera are known in the art, see for example, Mayer and Walker (1987). An effective immunization protocol for rabbits can be found in Vaitukaitis, J. et al. *J. Clin. Endocrinol. Metab.* 33:988–991 (1971).

Booster injections can be given at regular intervals, and antiserum harvested when antibody titer thereof, as determined semi-quantitatively, for example, by double immunodiffusion in agar against known concentrations of the antigen, begins to fall. (See, for example, Ouchterlony, O. et al., Chap. 19 in: Handbook of Experimental Immunology D. Wier (ed) Blackwell,1973). Plateau concentration of antibody is usually in the range of 0.1 to 0.2 mg/ml of serum. Affinity of the antisera for the antigen is determined by preparing competitive binding curves, as described, for example, by Fisher, D., (Chap. 42: *Manual of Clinical Immunology*, 2d Ed. Rose and Friedman, Eds., Amer. Soc. For Microbiol., Washington, D.C., 1980).

Antibody preparations prepared according to either the monoclonal or the polyclonal protocol are useful in quantitative immunoassays which determine concentrations of antigen-bearing substances in biological samples; they are also used semi-quantitatively or qualitatively to identify the presence of antigen in a biological sample. The antibodies may also be used in therapeutic compositions for killing cells expressing the protein or reducing the levels of the protein in the body.

Example 7

Forensic Matching by Microsequencing

DNA samples are isolated from forensic specimens of, for example, hair, semen, blood or skin cells by conventional methods. A panel of PCR primers based on a number of the sequences of the invention is then utilized according to the methods described herein to amplify DNA of approximately 500 bases in length from the forensic specimen. The alleles present at each of the selected biallelic markers site according to biallelic markers of the invention are then identified according Examples discussed herein. A simple database comparison of the analysis results determines the differences, if any, between the sequences from a subject individual or from a database and those from the forensic sample. In a preferred method, statistically significant differences between the suspect's DNA sequences and those from the sample conclusively prove a lack of identity. This lack of identity can be proven, for example, with only one sequence. Identity, on the other hand, should be demonstrated with a large number of sequences, all matching. Preferably, a minimum of 13, 17, 20, 25, 30, 40, 50, 66, 70, 85, 88, 100, 187, 200 or 500 biallelic markers are used to test identity between the suspect and the sample.

It should be noted that in the accompanying Sequence Listing, all instances of the symbol "n" in the nucleic acid sequences mean that the nucleotide can be adenine, guanine, cytosine or thymine.

In some instances, the polymorphic bases of the biallelic markers alter the identity of amino acids in the encoded polypeptide. This is indicated in the accompanying Sequence Listing by use of the feature VARIANT, placement of a Xaa at the position of the polymorphic amino acid, and definition of Xaa as the two alternative amino acids. For example, if one allele of a biallelic marker is the codon CAC, which encodes histidine, while the other allele of the biallelic marker is CAA, which encodes glutamine, the Sequence Listing for the encoded polypeptide will contain an Xaa at the location of the polymorphic amino acid. In this instance, Xaa would be defined as being histidine or glutamine.

In other instances, Xaa may indicate an amino acid whose identity is unknown because of nucleotide sequence ambiguity. In this instance, the feature UNSURE is used, Xaa is placed at the position of the unknown amino acid, and Xaa is defined as being any of the 20 amino acids or a limited number of amino acids suggested by the genetic code.

TABLE 11A

| GENE | BIALLELIC MARKER ID | SEQ ID. NO. | BIALLELIC MARKER POSITION IN SEQ ID NO. | VALIDATION MICRO-SEQUENCING | GENOTYPING LEAST COMMON ALLELE FREQUENCY % | |
|---|---|---|---|---|---|---|
| MGST2 | 12-421-140 | 1 | 501 | N | | |
| MGST2 | 12-424-192 | 2 | 501 | N | | |
| MGST2 | 12-424-198 | 3 | 501 | N | | |
| MGST2 | 12-425-57 | 4 | 501 | N | | |
| MGST2 | 12-426-154 | 5 | 461 | N | | |
| MGST2 | 12-429-198 | 6 | 501 | N | | |
| MGST2 | 12-430-80 | 7 | 501 | Y | T | 5.38 |
| MGST2 | 12-433-215 | 8 | 501 | N | | |
| MGST2 | 12-441-233 | 9 | 501 | Y | G | 34.48 |
| MGST2 | 12-441-343 | 10 | 501 | N | | |
| MGST2 | 12-442-221 | 11 | 501 | N | | |
| MGST2 | 12-447-58 | 12 | 501 | Y | G | 34.27 |
| MGST2 | 12-453-429 | 13 | 501 | Y | T | 42.55 |
| MGST2 | 12-454-363 | 14 | 501 | N | | |
| MGST2 | 12-455-326 | 15 | 501 | Y | C | 41.94 |
| MGST2 | 12-455-383 | 16 | 501 | N | | |
| MGST2 | 12-456-269 | 17 | 501 | N | | |
| MGST2 | 12-456-380 | 18 | 501 | N | | |
| MGST2 | 12-457-204 | 19 | 501 | N | | |
| MGST2 | 12-457-206 | 20 | 501 | N | | |
| MGST2 | 12-458-196 | 21 | 501 | N | | |
| MGST2 | 12-458-438 | 22 | 501 | N | | |
| MGST2 | 12-460-274 | 23 | 501 | N | | |
| MGST2 | 12-461-124 | 24 | 501 | N | | |
| MGST2 | 12-461-299 | 25 | 501 | Y | C | 42.39 |
| MGST2 | 12-461-465 | 26 | 501 | N | | |
| MGST2 | 12-462-280 | 27 | 501 | N | | |
| MGST2 | 12-464-66 | 28 | 501 | N | | |
| MGST2 | 12-465-26 | 29 | 501 | N | | |
| MGST2 | 12-465-234 | 30 | 501 | N | | |
| ME1 | 10-428-219 | 31 | 501 | N | | |
| ME1 | 10-429-84 | 32 | 501 | N | | |
| ME1 | 10-420-284 | 33 | 501 | N | | |
| ME1 | 10-423-411 | 34 | 501 | N | | |
| ME1 | 12-713-95 | 35 | 232 | Y | C | 31.18 |
| ME1 | 12-713-149 | 36 | 286 | N | | |
| ME1 | 12-716-295 | 37 | 500 | Y | T | 32.8 |
| ME1 | 12-720-80 | 38 | 480 | Y | C | 33.69 |
| ME1 | 12-721-281 | 40 | 426 | N | | |
| ME1 | 12-721-440 | 41 | 501 | Y | A | 1.6 |
| ME1 | 12-723-293 | 42 | 503 | Y | T | 0.54 |
| ME1 | 12-724-195 | 43 | 501 | N | | |
| ME1 | 12-724-225 | 44 | 501 | Y | T | 25.86 |
| CYP1A2 | 10-153-329 | 45 | 330 | Y | G | 2.69 |
| CYP1A2 | 10-95-342 | 46 | 342 | Y | A | 0.54 |
| CYP1A2 | 10-100-277 | 47 | 277 | Y | C | 2.33 |

TABLE 11A-continued

| GENE | BIALLELIC MARKER ID | SEQ ID. NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| CYP1A2 | 10-102-294 | 48 | 297 | Y | C | 30.85 |
| CYP2C8 | 10-413-394 | 49 | 501 | Y | A | 38.07 |
| CYP2C8 | 10-414-243 | 50 | 501 | N | | |
| CYP2C8 | 10-416-273 | 51 | 501 | Y | T | 39.25 |
| CYP2C8 | 10-418-177 | 52 | 501 | Y | G | 11.41 |
| CYP2C8 | 12-665-315 | 53 | 501 | Y | T | 22.58 |
| CYP2C8 | 12-666-324 | 54 | 501 | Y | C | 10.87 |
| CYP2C9 | 10-76-177 | 56 | 178 | N | | |
| CYP2C9 | 10-76-217 | 57 | 218 | N | | |
| CYP2C9 | 10-76-333 | 58 | 334 | Y | G | 13.04 |
| CYP2C9 | 10-77-316 | 59 | 501 | N | | |
| CYP2C9 | 10-155-78 | 60 | 78 | N | | |
| CYP2C9 | 10-155-104 | 61 | 104 | N | | |
| CYP2C9 | 10-156-52 | 62 | 52 | Y | A | 4.79 |
| CYP2C9 | 10-157-39 | 63 | 39 | Y | C | 30.65 |
| CYP2C9 | 10-157-131 | 64 | 131 | Y | | |
| CYP2C9 | 10-157-166 | 65 | 166 | N | | |
| CYP2C9 | 10-157-246 | 66 | 246 | N | | |
| CYP2C9 | 10-159-161 | 67 | 161 | Y | A | 11.29 |
| CYP2C9 | 10-159-162 | 68 | 162 | N | | |
| CYP2C18 | 10-83-169 | 69 | 169 | Y | T | 12.9 |
| CYP2C18 | 10-84-152 | 70 | 152 | N | | |
| CYP2C18 | 10-84-243 | 71 | 243 | Y | T | 32.56 |
| CYP2C18 | 10-84-277 | 72 | 277 | N | | |
| CYP2C18 | 10-84-295 | 73 | 295 | Y | | |
| CYP2C18 | 10-85-43 | 74 | 43 | Y | | |
| CYP2C18 | 10-85-117 | 75 | 117 | Y | T | 12.35 |
| CYP2C18 | 10-85-320 | 76 | 320 | N | | |
| CYP2C18 | 10-86-121 | 77 | 121 | Y | | |
| CYP3A4–CYP3A7 | 12-244-275 | 78 | 501 | N | | |
| CYP3A4–CYP3A7 | 12-251-153 | 79 | 450 | Y | | |
| CYP3A4–CYP3A7 | 12-254-115 | 80 | 246 | N | | |
| CYP3A4–CYP3A7 | 12-254-180 | 81 | 311 | Y | | |
| CYP3A4–CYP3A7 | 12-265-300 | 82 | 499 | N | | |
| CYP3A4–CYP3A7 | 12-271-118 | 83 | 501 | N | | |
| CYP3A4–CYP3A7 | 12-272-112 | 84 | 501 | Y | | |
| CYP3A7 | 10-216-182 | 85 | 503 | Y | A | 6.59 |
| CYP3A7 | 10-217-91 | 86 | 501 | Y | T | 12.64 |
| CYP3A7 | 10-213-292 | 87 | 503 | Y | G | 12.9 |
| CYP3A7 | 10-214-279 | 88 | 501 | Y | C | 13.3 |
| CYP3A7 | 10-214-380 | 89 | 501 | Y | G | 13.44 |
| FMO | 2-1-216 | 90 | 216 | N | | |
| FMO | 2-1-397 | 91 | 397 | N | | |
| FMO | 2-3-232 | 92 | 232 | N | | |
| FMO | 2-4-51 | 93 | 51 | N | | |
| FMO | 2-4-126 | 94 | 126 | N | | |
| FMO | 2-5-202 | 95 | 202 | N | | |
| FMO | 2-5-275 | 96 | 275 | N | | |
| FMO | 2-5-346 | 97 | 346 | N | | |
| FMO | 2-8-171 | 98 | 171 | N | | |
| FMO | 2-9-188 | 99 | 188 | N | | |
| FMO | 2-9-223 | 100 | 223 | N | | |
| FMO | 2-10-107 | 101 | 107 | N | | |
| FMO | 2-10-378 | 102 | 377 | N | | |
| FMO | 2-11-284 | 103 | 284 | N | | |
| FMO | 2-11-156 | 104 | 156 | N | | |
| FMO | 2-11-379 | 105 | 379 | N | | |
| FMO | 2-12-223 | 106 | 223 | N | | |
| FMO | 2-14-239 | 107 | 239 | N | | |
| FMO | 2-14-370 | 108 | 370 | N | | |
| FMO | 2-17-104 | 109 | 104 | N | | |
| FMO | 2-17-396 | 110 | 395 | N | | |
| FMO | 2-22-43 | 111 | 43 | N | | |
| FMO | 2-22-138 | 112 | 138 | N | | |
| FMO | 2-23-82 | 113 | 82 | N | | |
| FMO | 2-23-166 | 114 | 166 | N | | |
| FMO | 2-23-244 | 115 | 244 | N | | |
| FMO | 2-24-115 | 116 | 115 | N | | |
| FMO | 2-25-36 | 117 | 36 | N | | |
| FMO | 2-27-185 | 118 | 185 | N | | |
| FMO | 2-27-378 | 119 | 378 | N | | |
| FMO | 2-29-142 | 120 | 142 | N | | |
| FMO | 2-29-166 | 121 | 166 | N | | |
| FMO | 2-29-205 | 122 | 204 | N | | |

TABLE 11A-continued

| GENE | BIALLELIC MARKER ID | SEQ ID. NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| FMO | 2-29-206 | 123 | 205 | N | | |
| FMO | 2-29-314 | 124 | 313 | N | | |
| FMO | 2-32-68 | 125 | 68 | N | | |
| FMO | 2-35-357 | 126 | 357 | N | | |
| FMO | 2-36-256 | 127 | 256 | N | | |
| FMO | 2-36-354 | 128 | 353 | N | | |
| FMO | 2-42-236 | 129 | 236 | N | | |
| FMO | 2-43-139 | 130 | 139 | N | | |
| FMO | 2-44-215 | 131 | 213 | N | | |
| FMO | 2-45-38 | 132 | 38 | N | | |
| FMO | 2-45-183 | 133 | 183 | N | | |
| FMO | 2-45-335 | 134 | 335 | N | | |
| FMO | 2-45-394 | 135 | 394 | N | | |
| FMO | 2-48-39 | 136 | 39 | N | | |
| FMO | 2-48-72 | 137 | 72 | N | | |
| FMO | 2-48-156 | 138 | 156 | N | | |
| FMO | 2-48-285 | 139 | 285 | N | | |
| FMO | 2-49-167 | 140 | 167 | N | | |
| GSHR | 10-436-43 | 141 | 501 | Y | C | 19.44 |
| GSHR | 10-436-376 | 142 | 501 | Y | A | 32.76 |
| GSHR | 10-431-51 | 143 | 501 | Y | A | 20.21 |
| GSHR | 10-432-93 | 144 | 477 | Y | | |
| GSHR | 12-631-208 | 145 | 433 | Y | G | 17.39 |
| GSHS | 10-260-282 | 146 | 501 | N | | |
| GSHS | 10-263-26 | 147 | 503 | N | | |
| GSHS | 10-258-408 | 148 | 501 | N | | |
| GSHS | 12-317-259 | 149 | 501 | N | | |
| GSHS | 12-323-385 | 150 | 501 | Y | T | 47.85 |
| GSHS | 12-324-219 | 151 | 357 | N | | |
| GSHS | 12-324-335 | 152 | 473 | Y | C | 35.16 |
| GSHS | 12-324-380 | 153 | 501 | N | | |
| GSHS | 12-325-30 | 154 | 501 | N | | |
| GSHS | 12-327-31 | 155 | 479 | Y | G | 47.87 |
| GSHS | 12-327-415 | 156 | 500 | N | | |
| GSHS | 12-331-270 | 157 | 501 | N | | |
| GSHS | 12-331-275 | 158 | 501 | N | | |
| GSHS | 12-334-320 | 159 | 503 | N | | |
| GSHS | 12-334-391 | 160 | 503 | N | | |
| GSHS | 12-335-417 | 161 | 501 | N | | |
| GSHS | 12-337-189 | 162 | 501 | N | | |
| GSHS | 12-340-130 | 163 | 381 | N | | |
| GSHS | 12-340-210 | 164 | 461 | Y | T | 46.81 |
| GSHS | 12-340-222 | 165 | 473 | N | | |
| GSHS | 12-340-240 | 166 | 491 | N | | |
| GSHS | 12-341-99 | 167 | 501 | Y | A | 17.2 |
| GSHS | 12-342-32 | 168 | 501 | N | | |
| GSHS | 12-344-349 | 169 | 501 | Y | G | 43.75 |
| GSHS | 12-345-453 | 170 | 501 | N | | |
| GSHS | 12-346-204 | 171 | 501 | N | | |
| GLCL | 10-364-55 | 172 | 501 | N | | |
| GLCL | 10-364-108 | 173 | 501 | N | | |
| GLCL | 10-364-267 | 174 | 501 | N | | |
| GLCL | 10-367-20 | 175 | 497 | N | | |
| GLCL | 10-351-389 | 176 | 501 | N | | |
| GLCL | 10-353-102 | 177 | 501 | N | | |
| GLCL | 12-474-346 | 178 | 501 | Y | A | 25.28 |
| GLCL | 10-354-320 | 179 | 501 | N | | |
| GLCL | 10-354-360 | 180 | 501 | N | | |
| GLCL | 10-355-87 | 181 | 501 | N | | |
| GLCL | 10-358-60 | 182 | 501 | N | | |
| GLCL | 12-468-63 | 183 | 501 | Y | C | 46.24 |
| GLCL | 12-468-388 | 184 | 501 | N | | |
| GLCL | 12-468-491 | 185 | 501 | N | | |
| GLCL | 12-469-132 | 186 | 501 | N | | |
| GLCL | 12-469-245 | 187 | 501 | N | | |
| GLCL | 12-472-435 | 188 | 501 | N | | |
| GLCL | 12-473-311 | 189 | 501 | N | | |
| GLCL | 12-473-483 | 190 | 501 | N | | |
| GLCL | 12-475-85 | 191 | 501 | N | | |
| GLCL | 12-475-446 | 192 | 485 | N | | |
| GLCL | 12-477-100 | 193 | 501 | N | | |
| GLCL | 12-477-331 | 194 | 501 | N | | |
| GLCL | 12-477-332 | 195 | 501 | N | | |
| GLCL | 12-477-44 | 196 | 501 | N | | |

TABLE 11A-continued

| GENE | BIALLELIC MARKER ID | SEQ ID. NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| GLCL | 12-478-223 | 197 | 501 | N | | |
| GLCL | 12-478-320 | 198 | 501 | N | | |
| GLCL | 12-479-289 | 199 | 501 | N | | |
| GLCL | 12-482-237 | 200 | 501 | N | | |
| GLCL | 12-482-285 | 201 | 501 | N | | |
| GLCL | 12-482-482 | 202 | 501 | N | | |
| GLCL | 12-483-322 | 203 | 499 | N | | |
| GLCL | 12-484-46 | 204 | 501 | N | | |
| GLCL | 12-490-312 | 205 | 501 | N | | |
| GLCL | 12-491-295 | 206 | 501 | N | | |
| GLCL | 12-493-417 | 207 | 501 | N | | |
| GLCL | 12-494-373 | 208 | 501 | N | | |
| GLCL | 12-495-166 | 209 | 501 | N | | |
| GLCL | 12-495-272 | 210 | 501 | N | | |
| GLCL | 12-495-424 | 211 | 501 | N | | |
| GLCL | 12-500-220 | 212 | 501 | N | | |
| GLCL | 12-501-155 | 213 | 501 | N | | |
| GLCL | 12-502-52 | 214 | 501 | N | | |
| GLCL | 12-503-62 | 215 | 501 | N | | |
| GLCL | 12-504-54 | 216 | 499 | N | | |
| GLCL | 12-504-96 | 217 | 501 | N | | |
| GLCL | 12-504-428 | 218 | 501 | Y | C | 47.22 |
| GLCL | 12-507-53 | 219 | 474 | Y | C | 47.78 |
| GLCL | 12-507-92 | 220 | 501 | N | | |
| GLCL | 12-507-159 | 221 | 500 | N | | |
| GLCL | 12-507-177 | 222 | 501 | N | | |
| GLCL | 12-508-29 | 223 | 501 | N | | |
| GLCL | 12-509-42 | 224 | 501 | N | | |
| GLCL | 12-509-126 | 225 | 501 | N | | |
| GLCL | 12-510-59 | 226 | 501 | N | | |
| GLCL | 12-511-74 | 227 | 501 | Y | C | 11.45 |
| GGT5 | 10-325-311 | 228 | 501 | N | | |
| GGT5 | 10-327-120 | 229 | 501 | N | | |
| GGT5 | 10-331-179 | 230 | 501 | N | | |
| GGT5 | 10-331-357 | 231 | 501 | N | | |
| GGT5 | 10-334-263 | 232 | 501 | N | | |
| GGT5 | 10-321-226 | 233 | 501 | N | | |
| GGT5 | 12-183-98 | 234 | 501 | N | | |
| GGT5 | 12-185-78 | 235 | 501 | N | | |
| GGT5 | 12-186-154 | 236 | 501 | Y | A | 6.99 |
| GGT5 | 12-186-397 | 237 | 501 | Y | C | 28.08 |
| GGT5 | 12-187-65 | 238 | 501 | Y | C | 23.37 |
| GGT5 | 12-187-66 | 239 | 501 | N | | |
| GGT5 | 12-189-348 | 240 | 501 | Y | A | 26.09 |
| GGT5 | 12-192-63 | 241 | 501 | N | | |
| GGT5 | 12-192-64 | 242 | 502 | N | | |
| GGT5 | 12-192-268 | 243 | 501 | N | | |
| GGT5 | 12-192-334 | 244 | 501 | N | | |
| GGT5 | 12-192-352 | 245 | 501 | N | | |
| GGT5 | 12-194-135 | 246 | 501 | N | | |
| GGT5 | 12-194-325 | 247 | 501 | N | | |
| GGT5 | 12-194-337 | 248 | 501 | N | | |
| GGT5 | 12-194-479 | 249 | 501 | N | | |
| DP | 10-442-133 | 250 | 501 | Y | C | 7.06 |
| DP | 10-444-248 | 251 | 484 | Y | G | 42.78 |
| DP | 10-445-281 | 252 | 501 | Y | T | 13.3 |
| DP | 12-668-362 | 253 | 501 | N | | |
| DP | 12-670-48 | 254 | 501 | N | | |
| DP | 12-670-91 | 255 | 501 | N | | |
| DP | 12-670-157 | 256 | 501 | Y | T | 47.83 |
| DP | 12-671-148 | 257 | 501 | Y | C | 41.49 |
| DP | 12-679-245 | 258 | 253 | N | | |
| DP | 12-679-371 | 259 | 379 | N | | |
| DP | 12-679-426 | 260 | 434 | N | | |
| DP | 12-680-331 | 261 | 503 | N | | |
| G6PDH | 10-151-154 | 262 | 154 | Y | A | 0.54 |
| G6PDH | 10-138-206 | 263 | 205 | Y | T | 8.51 |
| G6PDH | 10-138-352 | 264 | 351 | Y | C | 14.04 |
| PGDH | 12-586-414 | 265 | 501 | Y | A | 28.33 |
| PGDH | 12-587-379 | 266 | 499 | N | | |
| PGDH | 12-588-103 | 267 | 501 | Y | A | 48.88 |
| PGDH | 12-589-152 | 268 | 501 | N | | |
| PGDH | 12-592-118 | 269 | 501 | Y | A | 49.46 |
| PGDH | 12-593-174 | 270 | 501 | Y | C | 34.71 |

TABLE 11A-continued

| GENE | BIALLELIC MARKER ID | SEQ ID. NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| PGDH | 12-596-124 | 271 | 501 | Y | A | 26.7 |
| PGDH | 12-602-196 | 272 | 501 | Y | C | 31.72 |
| PGDH | 12-602-350 | 273 | 501 | N | | |
| PGDH | 12-603-191 | 274 | 501 | Y | C | 27.42 |
| PGDH | 12-783-73 | 275 | 501 | N | | |
| PGDH | 12-783-421 | 276 | 501 | N | | |
| PGDH | 12-785-200 | 277 | 501 | N | | |
| PGDH | 12-785-393 | 278 | 501 | N | | |
| PGDH | 12-787-103 | 279 | 501 | N | | |
| PGDH | 12-790-396 | 280 | 501 | N | | |
| PGDH | 12-791-211 | 281 | 501 | N | | |
| PGDH | 12-792-233 | 282 | 501 | N | | |
| PGDH | 12-793-383 | 283 | 505 | N | | |
| PGDH | 12-803-125 | 284 | 501 | N | | |
| PGDH | 12-805-115 | 285 | 501 | N | | |
| PGDH | 12-808-52 | 286 | 501 | N | | |
| PGDH | 12-808-75 | 287 | 501 | N | | |
| PGDH | 12-809-119 | 288 | 501 | N | | |
| PGDH | 12-810-77 | 289 | 501 | N | | |
| PGDH | 10-265-178 | 290 | 501 | N | | |
| PGDH | 10-266-203 | 291 | 503 | N | | |
| UGT1A7 | 10-403-312 | 292 | 501 | N | | |
| UGT1A7 | 10-405-54 | 293 | 501 | N | | |
| UGT1A7 | 10-408-356 | 294 | 501 | N | | |
| UGT1A7 | 10-409-148 | 295 | 501 | N | | |
| UGT1A7 | 10-409-249 | 296 | 501 | N | | |
| UGT1A7 | 10-410-274 | 297 | 501 | N | | |
| UGT1A7 | 10-410-280 | 298 | 501 | N | | |
| UGT1A7 | 10-410-337 | 299 | 501 | N | | |
| UGT1A7 | 12-121-326 | 300 | 501 | Y | A | 26.88 |
| UGT1A7 | 12-122-341 | 301 | 501 | N | | |
| UGT1A7 | 12-122-381 | 302 | 501 | N | | |
| UGT1A7 | 12-124-169 | 303 | 501 | N | | |
| UGT1A7 | 12-124-194 | 304 | 501 | Y | C | 19.41 |
| UGT1A7 | 12-124-300 | 305 | 501 | N | | |
| UGT1A7 | 12-124-58 | 306 | 501 | N | | |
| UGT1A7 | 12-126-222 | 307 | 501 | N | | |
| UGT1A7 | 12-126-297 | 308 | 501 | N | | |
| UGT1A7 | 12-128-225 | 309 | 501 | Y | G | 47.44 |
| UGT1A7 | 12-129-176 | 310 | 501 | N | | |
| UGT1A7 | 12-130-203 | 311 | 501 | N | | |
| UGT1A7 | 12-130-260 | 312 | 501 | N | | |
| UGT1A7 | 12-131-112 | 313 | 501 | N | | |
| UGT1A7 | 12-132-157 | 314 | 255 | N | | |
| UGT1A7 | 12-132-437 | 315 | 501 | N | | |
| UGT1A7 | 12-133-153 | 316 | 666 | N | | |
| UGT1A7 | 12-133-318 | 317 | 501 | N | | |
| UGT1A7 | 12-136-238 | 318 | 249 | N | | |
| UGT1A7 | 12-138-141 | 319 | 501 | N | | |
| UGT1A7 | 12-138-42 | 320 | 501 | N | | |
| UGT1A7 | 12-138-67 | 321 | 501 | N | | |
| UGT1A7 | 12-139-380 | 322 | 501 | Y | A | 21.24 |
| UGT1A7 | 12-140-134 | 323 | 501 | Y | T | 41.04 |
| UGT1A7 | 12-140-329 | 324 | 501 | N | | |
| UGT1A7 | 12-140-385 | 325 | 501 | N | | |
| UGT1A7 | 12-141-159 | 326 | 501 | Y | T | 37.5 |
| UGT1A7 | 12-141-392 | 327 | 501 | N | | |
| UGT1A7 | 12-142-315 | 328 | 501 | N | | |
| UGT1A7 | 12-142-321 | 329 | 501 | Y | G | 45.56 |
| UGT1A7 | 12-143-453 | 330 | 501 | Y | G | 49.39 |
| UGT1A7 | 12-144-169 | 331 | 501 | N | | |
| UGT1A7 | 12-144-33 | 332 | 501 | N | | |
| UGT1A7 | 12-146-174 | 333 | 501 | N | | |
| UGT1A7 | 12-146-47 | 334 | 501 | N | | |
| UGT1A7 | 12-148-283 | 335 | 501 | N | | |
| UGT1A7 | 12-148-311 | 336 | 501 | Y | T | 43.17 |
| UGT1A7 | 12-149-320 | 337 | 501 | N | | |
| UGT1A7 | 12-151-174 | 338 | 501 | N | | |
| UGT1A7 | 12-151-196 | 339 | 501 | N | | |
| UGT1A7 | 12-151-270 | 340 | 501 | N | | |
| UGT1A7 | 12-512-453 | 341 | 501 | N | | |
| UGT1A7 | 12-153-116 | 342 | 501 | Y | T | 37.78 |
| UGT1A7 | 12-154-480 | 343 | 501 | N | | |
| UGT1A7 | 12-155-403 | 344 | 501 | N | | |

TABLE 11A-continued

| GENE | BIALLELIC MARKER ID | SEQ ID. NO. | BIALLELIC MARKER POSITION IN SEQ ID NO. | VALIDATION MICRO-SEQUENCING | GENOTYPING LEAST COMMON ALLELE FREQUENCY % | |
|---|---|---|---|---|---|---|
| UGT1A7 | 12-156-91 | 345 | 501 | Y | A | 50 |
| UGT1A7 | 12-157-437 | 346 | 501 | N | | |
| UGT1A7 | 12-158-213 | 347 | 501 | N | | |
| UGT1A7 | 12-158-450 | 348 | 480 | N | | |
| UGT1A7 | 12-161-157 | 349 | 501 | N | | |
| UGT1A7 | 12-162-21 | 350 | 498 | N | | |
| UGT2B4 | 12-470-25 | 351 | 503 | Y | T | 44.44 |
| UGT2B4 | 12-471-84 | 352 | 503 | Y | A | 27.17 |
| UGT2B4 | 12-471-85 | 353 | 503 | Y | | |
| UGT2B4 | 12-473-333 | 355 | 503 | N | | |
| UGT2B4 | 12-494-284 | 356 | 503 | N | | |
| UGT2B4 | 12-637-219 | 357 | 499 | Y | G | 36.17 |
| UGT2B4 | 12-639-95 | 358 | 499 | Y | G | 34.95 |
| UGT2B4 | 12-639-241 | 359 | 499 | N | | |
| UGT2B4 | 12-640-151 | 360 | 499 | N | | |
| UGT2B4 | 12-640-296 | 361 | 499 | N | | |
| UGT2B4 | 12-640-325 | 362 | 499 | Y | | |
| UGT2B4 | 12-640-413 | 363 | 499 | N | | |
| UGT2B4 | 12-641-120 | 364 | 499 | N | | |
| UGT2B4 | 12-641-122 | 365 | 499 | N | | |
| UGT2B4 | 12-641-223 | 366 | 432 | N | | |
| UGT2B4 | 12-641-267 | 367 | 388 | N | | |
| UGT2B4 | 12-642-387 | 368 | 503 | N | | |
| UGT2B4 | 12-642-417 | 369 | 503 | Y | G | 26.51 |
| UGT2B4 | 12-646-429 | 370 | 434 | N | | |
| UGT2B4 | 12-646-433 | 371 | 438 | N | | |
| UGT2B4 | 12-647-145 | 372 | 503 | N | | |
| UGT2B4 | 12-648-123 | 373 | 251 | N | | |
| UGT2B4 | 12-648-300 | 374 | 428 | Y | T | 37.91 |
| UGT2B4 | 12-648-402 | 375 | 501 | N | | |
| UGT2B4 | 12-652-115 | 376 | 298 | N | | |
| UGT2B4 | 12-652-203 | 377 | 386 | Y | C | 42.47 |
| UGT2B4 | 12-652-274 | 378 | 457 | N | | |
| UGT2B4 | 12-652-371 | 379 | 501 | N | | |
| UGT2B4 | 12-653-423 | 380 | 499 | N | | |
| UGT2B4 | 12-654-115 | 381 | 499 | N | | |
| UGT2B4 | 12-654-207 | 382 | 499 | N | | |
| UGT2B4 | 12-657-396 | 383 | 503 | N | | |
| UGT2B4 | 12-658-120 | 384 | 503 | N | | |
| UGT2B4 | 12-659-382 | 385 | 501 | N | | |
| UGT2B4 | 12-660-134 | 386 | 306 | N | | |
| UGT2B4 | 12-662-80 | 387 | 497 | N | | |
| UGT2B7 | 12-906-149 | 388 | 501 | Y | | |
| UGT2B7 | 12-906-154 | 389 | 501 | N | | |
| UGT2B7 | 12-906-251 | 390 | 501 | N | | |
| UGT2B7 | 12-906-451 | 391 | 501 | N | | |
| UGT2B7 | 12-907-199 | 392 | 244 | Y | G | 3.23 |
| UGT2B7 | 12-907-482 | 393 | 501 | N | | |
| UGT2B7 | 12-909-36 | 394 | 53 | N | | |
| UGT2B7 | 12-909-176 | 395 | 193 | N | | |
| UGT2B7 | 12-909-484 | 396 | 501 | N | | |
| UGT2B7 | 12-910-76 | 397 | 347 | Y | A | 23.91 |
| UGT2B7 | 12-910-295 | 398 | 503 | N | | |
| UGT2B7 | 12-911-22 | 399 | 240 | Y | C | 43.96 |
| UGT2B7 | 12-912-65 | 400 | 501 | N | | |
| UGT2B7 | 12-914-106 | 401 | 384 | Y | C | 44.62 |
| UGT2B7 | 12-914-252 | 402 | 503 | N | | |
| UGT2B10 | 10-448-266 | 403 | 503 | N | | |
| UGT2B10 | 10-453-330 | 404 | 503 | N | | |
| UGT2B10 | 10-455-367 | 405 | 503 | N | | |
| UGT2B10 | 12-5-158 | 406 | 503 | Y | T | 11.8 |
| UGT2B10 | 12-9-367 | 407 | 499 | Y | A | 14.67 |
| UGT2B10 | 12-10-303 | 408 | 501 | Y | T | 14.67 |
| UGT2B10 | 12-14-264 | 409 | 501 | Y | T | 14.29 |
| UGT2B10 | 12-17-86 | 410 | 499 | Y | A | 44.02 |
| UGT2B10 | 12-19-163 | 411 | 501 | Y | G | 29.89 |
| UGT2B15 | 10-457-284 | 412 | 503 | N | | |
| UGT2B15 | 10-460-221 | 413 | 503 | N | | |
| UGT2B15 | 10-460-232 | 414 | 503 | N | | |
| UGT2B15 | 10-460-235 | 415 | 503 | N | | |
| UGT2B15 | 10-460-236 | 416 | 503 | N | | |
| UGT2B15 | 10-460-285 | 417 | 503 | N | | |
| UGT2B15 | 12-605-58 | 418 | 501 | Y | T | 47.67 |
| UGT2B15 | 12-607-207 | 419 | 501 | N | | |

TABLE 11A-continued

| GENE | BIALLELIC MARKER ID | SEQ ID. NO. | BIALLELIC MARKER POSITION IN SEQ ID NO. | VALIDATION MICRO-SEQUENCING | GENOTYPING LEAST COMMON ALLELE | FREQUENCY % |
| --- | --- | --- | --- | --- | --- | --- |
| UGT2B15 | 12-609-119 | 420 | 499 | Y | T | 45.11 |
| UGT2B15 | 12-609-180 | 421 | 499 | N | | |
| UGT2B15 | 12-609-233 | 422 | 499 | N | | |
| UGT2B15 | 12-611-294 | 423 | 501 | Y | A | 43.26 |
| UGT2B15 | 12-612-41 | 424 | 501 | Y | C | 28.65 |
| UGT2B15 | 12-613-302 | 425 | 499 | N | | |
| UGT2B15 | 12-614-471 | 426 | 501 | Y | T | 39.44 |
| UGT2B15 | 12-620-192 | 427 | 503 | Y | T | 30.36 |
| UGT2B15 | 12-621-49 | 428 | 503 | N | | |
| UGT2B15 | 12-622-325 | 429 | 364 | N | | |
| UGT2B15 | 12-624-82 | 430 | 501 | N | | |
| UGT2B15 | 12-624-83 | 431 | 501 | N | | |
| UGT2B15 | 12-624-107 | 432 | 489 | N | | |
| UGT2B15 | 12-624-146 | 433 | 501 | N | | |
| UGT2B15 | 12-624-288 | 434 | 501 | N | | |
| UGT2B15 | 12-624-293 | 435 | 501 | N | | |
| MGST2 | 12-421-135 | 436 | 501 | N | | |
| MGST2 | 12-442-133 | 437 | 501 | Y | C | 5.85 |
| MGST2 | 12-449-63 | 438 | 501 | N | | |

TABLE 11B

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
| --- | --- | --- | --- | --- | --- | --- |
| MGST2 | 12-421-140 | 494 | 24 | N | | |
| MGST2 | 12-424-192 | 495 | 24 | N | | |
| MGST2 | 12-424-198 | 496 | 24 | N | | |
| MGST2 | 12-425-57 | 497 | 24 | N | | |
| MGST2 | 12-426-154 | 498 | 24 | N | | |
| MGST2 | 12-429-198 | 499 | 24 | N | | |
| MGST2 | 12-430-80 | 500 | 24 | Y | T | 5.38 |
| MGST2 | 12-433-215 | 501 | 24 | N | | |
| MGST2 | 12-441-233 | 502 | 24 | Y | G | 34.48 |
| MGST2 | 12-441-343 | 503 | 24 | N | | |
| MGST2 | 12-442-221 | 504 | 24 | N | | |
| MGST2 | 12-447-58 | 505 | 24 | Y | G | 34.27 |
| MGST2 | 12-453-429 | 506 | 24 | Y | T | 42.55 |
| MGST2 | 12-454-363 | 507 | 24 | N | | |
| MGST2 | 12-455-326 | 508 | 24 | Y | C | 41.94 |
| MGST2 | 12-455-383 | 509 | 24 | N | | |
| MGST2 | 12-456-269 | 510 | 24 | N | | |
| MGST2 | 12-456-380 | 511 | 24 | N | | |
| MGST2 | 12-457-204 | 512 | 24 | N | | |
| MGST2 | 12-457-206 | 513 | 24 | N | | |
| MGST2 | 12-458-196 | 514 | 24 | N | | |
| MGST2 | 12-458-438 | 515 | 24 | N | | |
| MGST2 | 12-460-274 | 516 | 24 | N | | |
| MGST2 | 12-461-124 | 517 | 24 | N | | |
| MGST2 | 12-461-299 | 518 | 24 | Y | C | 42.39 |
| MGST2 | 12-461-465 | 519 | 24 | N | | |
| MGST2 | 12-462-280 | 520 | 24 | N | | |
| MGST2 | 12-464-66 | 521 | 24 | N | | |
| MGST2 | 12-465-26 | 522 | 24 | N | | |
| MGST2 | 12-465-234 | 523 | 24 | N | | |
| ME1 | 10-428-219 | 524 | 24 | N | | |
| ME1 | 10-429-84 | 525 | 24 | N | | |
| ME1 | 10-420-284 | 526 | 24 | N | | |
| ME1 | 10-423-411 | 527 | 24 | N | | |
| ME1 | 12-713-95 | 528 | 24 | Y | C | 31.18 |
| ME1 | 12-713-149 | 529 | 24 | N | | |
| ME1 | 12-716-295 | 530 | 24 | Y | T | 32.8 |
| ME1 | 12-720-80 | 531 | 24 | Y | C | 33.69 |
| ME1 | 12-721-281 | 533 | 24 | N | | |
| ME1 | 12-721-440 | 534 | 24 | Y | A | 1.6 |
| ME1 | 12-723-293 | 535 | 24 | Y | T | 0.54 |
| ME1 | 12-724-195 | 536 | 24 | N | | |
| ME1 | 12-724-225 | 537 | 24 | Y | T | 25.86 |
| CYP1A2 | 10-153-329 | 538 | 24 | Y | G | 2.69 |

TABLE 11B-continued

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE FREQUENCY % | |
|---|---|---|---|---|---|---|
| CYP1A2 | 10-95-342 | 539 | 24 | Y | A | 0.54 |
| CYP1A2 | 10-100-277 | 540 | 24 | Y | C | 2.33 |
| CYP1A2 | 10-102-294 | 541 | 24 | Y | C | 30.85 |
| CYP2C8 | 10-453-394 | 542 | 24 | Y | A | 38.07 |
| CYP2C8 | 10-414-243 | 543 | 24 | N | | |
| CYP2C8 | 10-416-273 | 544 | 24 | Y | T | 39.25 |
| CYP2C8 | 10-418-177 | 545 | 24 | Y | G | 11.41 |
| CYP2C8 | 12-665-315 | 546 | 24 | Y | T | 22.58 |
| CYP2C8 | 12-666-324 | 547 | 24 | Y | C | 10.87 |
| CYP2C9 | 10-76-177 | 549 | 24 | N | | |
| CYP2C9 | 10-76-217 | 550 | 24 | N | | |
| CYP2C9 | 10-76-333 | 551 | 24 | Y | G | 13.04 |
| CYP2C9 | 10-77-316 | 552 | 24 | N | | |
| CYP2C9 | 10-155-78 | 553 | 24 | N | | |
| CYP2C9 | 10-155-104 | 554 | 24 | N | | |
| CYP2C9 | 10-156-52 | 555 | 24 | Y | A | 4.79 |
| CYP2C9 | 10-157-39 | 556 | 24 | Y | C | 30.65 |
| CYP2C9 | 10-157-131 | 557 | 24 | Y | | |
| CYP2C9 | 10-157-166 | 558 | 24 | N | | |
| CYP2C9 | 10-157-246 | 559 | 24 | N | | |
| CYP2C9 | 10-159-161 | 560 | 24 | Y | A | 11.29 |
| CYP2C9 | 10-159-162 | 561 | 24 | N | | |
| CYP2C18 | 10-83-169 | 562 | 24 | Y | T | 12.9 |
| CYP2C18 | 10-84-152 | 563 | 24 | N | | |
| CYP2C18 | 10-84-243 | 564 | 24 | Y | T | 32.56 |
| CYP2C18 | 10-84-277 | 565 | 24 | N | | |
| CYP2C18 | 10-84-295 | 566 | 24 | Y | | |
| CYP2C18 | 10-85-43 | 567 | 24 | Y | | |
| CYP2C18 | 10-85-117 | 568 | 24 | Y | T | 12.35 |
| CYP2C18 | 10-85-320 | 569 | 24 | N | | |
| CYP2C18 | 10-86-121 | 570 | 24 | Y | | |
| CYP3A4–CYP3A7 | 12-244-275 | 571 | 24 | N | | |
| CYP3A4–CYP3A7 | 12-251-153 | 572 | 24 | Y | | |
| CYP3A4–CYP3A7 | 12-254-115 | 573 | 24 | N | | |
| CYP3A4–CYP3A7 | 12-254-180 | 574 | 24 | Y | | |
| CYP3A4–CYP3A7 | 12-265-300 | 575 | 24 | N | | |
| CYP3A4–CYP3A7 | 12-271-118 | 576 | 24 | N | | |
| CYP3A4–CYP3A7 | 12-272-112 | 577 | 24 | Y | | |
| CYP3A7 | 10-216-182 | 578 | 24 | Y | A | 6.59 |
| CYP3A7 | 10-217-91 | 579 | 24 | Y | T | 12.64 |
| CYP3A7 | 10-213-292 | 580 | 24 | Y | G | 12.9 |
| CYP3A7 | 10-214-279 | 581 | 24 | Y | C | 13.3 |
| CYP3A7 | 10-214-380 | 582 | 24 | Y | G | 13.44 |
| FMO | 2-1-216 | 583 | 24 | N | | |
| FMO | 2-1-397 | 584 | 24 | N | | |
| FMO | 2-3-232 | 585 | 24 | N | | |
| FMO | 2-4-51 | 586 | 24 | N | | |
| FMO | 2-4-126 | 587 | 24 | N | | |
| FMO | 2-5-202 | 588 | 24 | N | | |
| FMO | 2-5-275 | 589 | 24 | N | | |
| FMO | 2-5-346 | 590 | 24 | N | | |
| FMO | 2-8-171 | 591 | 24 | N | | |
| FMO | 2-9-188 | 592 | 24 | N | | |
| FMO | 2-9-223 | 593 | 24 | N | | |
| FMO | 2-10-107 | 594 | 24 | N | | |
| FMO | 2-10-378 | 595 | 24 | N | | |
| FMO | 2-11-284 | 596 | 24 | N | | |
| FMO | 2-11-156 | 597 | 24 | N | | |
| FMO | 2-11-379 | 598 | 24 | N | | |
| FMO | 2-12-223 | 599 | 24 | N | | |
| FMO | 2-14-239 | 600 | 24 | N | | |
| FMO | 2-14-370 | 601 | 24 | N | | |
| FMO | 2-17-104 | 602 | 24 | N | | |
| FMO | 2-17-396 | 603 | 24 | N | | |
| FMO | 2-22-43 | 604 | 24 | N | | |
| FMO | 2-22-138 | 605 | 24 | N | | |
| FMO | 2-23-82 | 606 | 24 | N | | |
| FMO | 2-23-166 | 607 | 24 | N | | |
| FMO | 2-23-244 | 608 | 24 | N | | |
| FMO | 2-24-115 | 609 | 24 | N | | |
| FMO | 2-25-36 | 610 | 24 | N | | |
| FMO | 2-27-185 | 611 | 24 | N | | |
| FMO | 2-27-378 | 612 | 24 | N | | |
| FMO | 2-29-142 | 613 | 24 | N | | |

TABLE 11B-continued

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| FMO | 2-29-166 | 614 | 24 | N | | |
| FMO | 2-29-205 | 615 | 24 | N | | |
| FMO | 2-29-206 | 616 | 24 | N | | |
| FMO | 2-29-314 | 617 | 24 | N | | |
| FMO | 2-32-68 | 618 | 24 | N | | |
| FMO | 2-35-357 | 619 | 24 | N | | |
| FMO | 2-36-256 | 620 | 24 | N | | |
| FMO | 2-36-354 | 621 | 24 | N | | |
| FMO | 2-42-236 | 622 | 24 | N | | |
| FMO | 2-43-139 | 623 | 24 | N | | |
| FMO | 2-44-215 | 624 | 24 | N | | |
| FMO | 2-45-38 | 625 | 24 | N | | |
| FMO | 2-45-183 | 626 | 24 | N | | |
| FMO | 2-45-335 | 627 | 24 | N | | |
| FMO | 2-45-394 | 628 | 24 | N | | |
| FMO | 2-48-39 | 629 | 24 | N | | |
| FMO | 2-48-72 | 630 | 24 | N | | |
| FMO | 2-48-156 | 631 | 24 | N | | |
| FMO | 2-48-285 | 632 | 24 | N | | |
| FMO | 2-49-167 | 633 | 24 | N | | |
| GSHR | 10-436-43 | 634 | 24 | Y | C | 19.44 |
| GSHR | 10-436-376 | 635 | 24 | Y | A | 32.76 |
| GSHR | 10-431-51 | 636 | 24 | Y | A | 20.21 |
| GSHR | 10-432-93 | 637 | 24 | Y | | |
| GSHR | 12-631-208 | 638 | 24 | Y | G | 17.39 |
| GSHS | 10-260-282 | 639 | 24 | N | | |
| GSHS | 10-263-26 | 640 | 24 | N | | |
| GSHS | 10-258-408 | 641 | 24 | N | | |
| GSHS | 12-317-259 | 642 | 24 | N | | |
| GSHS | 12-323-385 | 643 | 24 | Y | T | 47.85 |
| GSHS | 12-324-219 | 644 | 24 | N | | |
| GSHS | 12-324-335 | 645 | 24 | Y | C | 35.16 |
| GSHS | 12-324-380 | 646 | 24 | N | | |
| GSHS | 12-325-30 | 647 | 24 | N | | |
| GSHS | 12-327-31 | 648 | 24 | Y | G | 47.87 |
| GSHS | 12-327-415 | 649 | 24 | N | | |
| GSHS | 12-331-270 | 650 | 24 | N | | |
| GSHS | 12-331-275 | 651 | 24 | N | | |
| GSHS | 12-334-320 | 652 | 24 | N | | |
| GSHS | 12-334-391 | 653 | 24 | N | | |
| GSHS | 12-335-417 | 654 | 24 | N | | |
| GSHS | 12-337-189 | 655 | 24 | N | | |
| GSHS | 12-340-130 | 656 | 24 | N | | |
| GSHS | 12-340-210 | 657 | 24 | Y | T | 46.81 |
| GSHS | 12-340-222 | 658 | 24 | N | | |
| GSHS | 12-340-240 | 659 | 24 | N | | |
| GSHS | 12-341-99 | 660 | 24 | Y | A | 17.2 |
| GSHS | 12-342-32 | 661 | 24 | N | | |
| GSHS | 12-344-349 | 662 | 24 | Y | G | 43.75 |
| GSHS | 12-345-453 | 663 | 24 | N | | |
| GSHS | 12-346-204 | 664 | 24 | N | | |
| GLCL | 10-364-55 | 665 | 24 | N | | |
| GLCL | 10-364-108 | 666 | 24 | N | | |
| GLCL | 10-364-267 | 667 | 24 | N | | |
| GLCL | 10-367-20 | 668 | 24 | N | | |
| GLCL | 10-351-389 | 669 | 24 | N | | |
| GLCL | 10-353-102 | 670 | 24 | N | | |
| GLCL | 12-474-346 | 671 | 24 | Y | A | 25.28 |
| GLCL | 10-354-320 | 672 | 24 | N | | |
| GLCL | 10-354-360 | 673 | 24 | N | | |
| GLCL | 10-355-87 | 674 | 24 | N | | |
| GLCL | 10-358-60 | 675 | 24 | N | | |
| GLCL | 12-468-63 | 676 | 24 | Y | C | 46.24 |
| GLCL | 12-468-388 | 677 | 24 | N | | |
| GLCL | 12-468-491 | 678 | 24 | N | | |
| GLCL | 12-469-132 | 679 | 24 | N | | |
| GLCL | 12-469-245 | 680 | 24 | N | | |
| GLCL | 12-472-435 | 681 | 24 | N | | |
| GLCL | 12-473-311 | 682 | 24 | N | | |
| GLCL | 12-473-483 | 683 | 24 | N | | |
| GLCL | 12-475-85 | 684 | 24 | N | | |
| GLCL | 12-475-446 | 685 | 24 | N | | |
| GLCL | 12-477-100 | 686 | 24 | N | | |
| GLCL | 12-477-331 | 687 | 24 | N | | |

TABLE 11B-continued

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| GLCL | 12-477-332 | 688 | 24 | N | | |
| GLCL | 12-477-44 | 689 | 24 | N | | |
| GLCL | 12-478-223 | 690 | 24 | N | | |
| GLCL | 12-478-320 | 691 | 24 | N | | |
| GLCL | 12-479-289 | 692 | 24 | N | | |
| GLCL | 12-482-237 | 693 | 24 | N | | |
| GLCL | 12-482-285 | 694 | 24 | N | | |
| GLCL | 12-482-482 | 695 | 24 | N | | |
| GLCL | 12-483-322 | 696 | 24 | N | | |
| GLCL | 12-484-46 | 697 | 24 | N | | |
| GLCL | 12-490-312 | 698 | 24 | N | | |
| GLCL | 12-491-295 | 699 | 24 | N | | |
| GLCL | 12-493-417 | 700 | 24 | N | | |
| GLCL | 12-494-373 | 701 | 24 | N | | |
| GLCL | 12-495-166 | 702 | 24 | N | | |
| GLCL | 12-495-272 | 703 | 24 | N | | |
| GLCL | 12-495-424 | 704 | 24 | N | | |
| GLCL | 12-500-220 | 705 | 24 | N | | |
| GLCL | 12-501-155 | 706 | 24 | N | | |
| GLCL | 12-503-52 | 707 | 24 | N | | |
| GLCL | 12-503-62 | 708 | 24 | N | | |
| GLCL | 12-504-54 | 709 | 24 | N | | |
| GLCL | 12-504-96 | 710 | 24 | N | | |
| GLCL | 12-504-428 | 711 | 24 | Y | C | 47.22 |
| GLCL | 12-507-53 | 712 | 24 | Y | C | 47.78 |
| GLCL | 12-507-92 | 713 | 24 | N | | |
| GLCL | 12-507-159 | 714 | 24 | N | | |
| GLCL | 12-507-177 | 715 | 24 | N | | |
| GLCL | 12-508-29 | 716 | 24 | N | | |
| GLCL | 12-509-42 | 717 | 24 | N | | |
| GLCL | 12-509-126 | 718 | 24 | N | | |
| GLCL | 12-510-59 | 719 | 24 | N | | |
| GLCL | 12-511-74 | 720 | 24 | Y | C | 11.45 |
| GGT5 | 10-325-311 | 721 | 24 | N | | |
| GGT5 | 10-327-120 | 722 | 24 | N | | |
| GGT5 | 10-331-179 | 723 | 24 | N | | |
| GGT5 | 10-331-357 | 724 | 24 | N | | |
| GGT5 | 10-334-263 | 725 | 24 | N | | |
| GGT5 | 10-321-226 | 726 | 24 | N | | |
| GGT5 | 12-183-98 | 727 | 24 | N | | |
| GGT5 | 12-185-78 | 728 | 24 | N | | |
| GGT5 | 12-186-154 | 729 | 24 | Y | A | 6.99 |
| GGT5 | 12-186-397 | 730 | 24 | Y | C | 28.08 |
| GGT5 | 12-187-65 | 731 | 24 | Y | C | 23.37 |
| GGT5 | 12-187-66 | 732 | 24 | N | | |
| GGT5 | 12-189-348 | 733 | 24 | Y | A | 26.09 |
| GGT5 | 12-192-63 | 734 | 24 | N | | |
| GGT5 | 12-192-64 | 735 | 24 | N | | |
| GGT5 | 12-192-268 | 736 | 24 | N | | |
| GGT5 | 12-192-334 | 737 | 24 | N | | |
| GGT5 | 12-192-352 | 738 | 24 | N | | |
| GGT5 | 12-194-135 | 739 | 24 | N | | |
| GGT5 | 12-194-325 | 740 | 24 | N | | |
| GGT5 | 12-194-337 | 741 | 24 | N | | |
| GGT5 | 12-194-479 | 742 | 24 | N | | |
| DP | 10-442-133 | 743 | 24 | Y | C | 7.06 |
| DP | 10-444-248 | 744 | 24 | Y | G | 42.78 |
| DP | 10-445-281 | 745 | 24 | Y | T | 13.3 |
| DP | 12-668-362 | 746 | 24 | N | | |
| DP | 12-670-48 | 747 | 24 | N | | |
| DP | 12-670-91 | 748 | 24 | N | | |
| DP | 12-670-157 | 749 | 24 | Y | T | 47.83 |
| DP | 12-671-148 | 750 | 24 | Y | C | 41.49 |
| DP | 12-679-245 | 751 | 24 | N | | |
| DP | 12-679-371 | 752 | 24 | N | | |
| DP | 12-679-426 | 753 | 24 | N | | |
| DP | 12-680-331 | 754 | 24 | N | | |
| G6PDH | 10-151-154 | 755 | 24 | Y | A | 0.54 |
| G6PDH | 10-138-206 | 756 | 24 | Y | T | 8.51 |
| G6PDH | 10-138-352 | 757 | 24 | Y | C | 14.04 |
| PGDH | 12-586-414 | 758 | 24 | Y | A | 28.33 |
| PGDH | 12-587-379 | 759 | 24 | N | | |
| PGDH | 12-588-103 | 760 | 24 | Y | A | 48.88 |
| PGDH | 12-589-152 | 761 | 24 | N | | |

TABLE 11B-continued

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE FREQUENCY % | |
|---|---|---|---|---|---|---|
| PGDH | 12-592-118 | 762 | 24 | Y | A | 49.46 |
| PGDH | 12-593-174 | 763 | 24 | Y | C | 34.71 |
| PGDH | 12-596-124 | 764 | 24 | Y | A | 26.7 |
| PGDH | 12-602-196 | 765 | 24 | Y | C | 31.72 |
| PGDH | 12-602-350 | 766 | 24 | N | | |
| PGDH | 12-603-191 | 767 | 24 | Y | C | 27.42 |
| PGDH | 12-783-73 | 768 | 24 | N | | |
| PGDH | 12-783-421 | 769 | 24 | N | | |
| PGDH | 12-785-200 | 770 | 24 | N | | |
| PGDH | 12-785-393 | 771 | 24 | N | | |
| PGDH | 12-787-103 | 772 | 24 | N | | |
| PGDH | 12-790-396 | 773 | 24 | N | | |
| PGDH | 12-791-211 | 774 | 24 | N | | |
| PGDH | 12-792-233 | 775 | 24 | N | | |
| PGDH | 12-793-383 | 776 | 24 | N | | |
| PGDH | 12-803-125 | 777 | 24 | N | | |
| PGDH | 12-805-115 | 778 | 24 | N | | |
| PGDH | 12-808-52 | 779 | 24 | N | | |
| PGDH | 12-808-75 | 780 | 24 | N | | |
| PGDH | 12-809-119 | 781 | 24 | N | | |
| PGDH | 12-810-77 | 782 | 24 | N | | |
| PGDH | 10-265-178 | 783 | 24 | N | | |
| PGDH | 10-266-203 | 784 | 24 | N | | |
| UGT1A7 | 10-403-312 | 785 | 24 | N | | |
| UGT1A7 | 10-405-54 | 786 | 24 | N | | |
| UGT1A7 | 10-408-356 | 787 | 24 | N | | |
| UGT1A7 | 10-409-148 | 788 | 24 | N | | |
| UGT1A7 | 10-409-249 | 789 | 24 | N | | |
| UGT1A7 | 10-410-274 | 790 | 24 | N | | |
| UGT1A7 | 10-410-280 | 791 | 24 | N | | |
| UGT1A7 | 10-410-337 | 792 | 24 | N | | |
| UGT1A7 | 12-121-326 | 793 | 24 | Y | A | 26.88 |
| UGT1A7 | 12-122-341 | 794 | 24 | N | | |
| UGT1A7 | 12-122-381 | 795 | 24 | N | | |
| UGT1A7 | 12-124-169 | 796 | 24 | N | | |
| UGT1A7 | 12-124-194 | 797 | 24 | Y | C | 19.41 |
| UGT1A7 | 12-124-300 | 798 | 24 | N | | |
| UGT1A7 | 12-124-58 | 799 | 24 | N | | |
| UGT1A7 | 12-126-222 | 800 | 24 | N | | |
| UGT1A7 | 12-126-297 | 801 | 24 | N | | |
| UGT1A7 | 12-128-225 | 802 | 24 | Y | G | 47.44 |
| UGT1A7 | 12-129-176 | 803 | 24 | N | | |
| UGT1A7 | 12-130-203 | 804 | 24 | N | | |
| UGT1A7 | 12-130-260 | 805 | 24 | N | | |
| UGT1A7 | 12-131-112 | 806 | 24 | N | | |
| UGT1A7 | 12-132-157 | 807 | 24 | N | | |
| UGT1A7 | 12-132-437 | 808 | 24 | N | | |
| UGT1A7 | 12-133-153 | 809 | 24 | N | | |
| UGT1A7 | 12-133-318 | 810 | 24 | N | | |
| UGT1A7 | 12-136-238 | 811 | 24 | N | | |
| UGT1A7 | 12-138-141 | 812 | 24 | N | | |
| UGT1A7 | 12-138-42 | 813 | 24 | N | | |
| UGT1A7 | 12-138-67 | 814 | 24 | N | | |
| UGT1A7 | 12-139-380 | 815 | 24 | Y | A | 21.24 |
| UGT1A7 | 12-140-134 | 816 | 24 | Y | T | 41.01 |
| UGT1A7 | 12-140-329 | 817 | 24 | N | | |
| UGT1A7 | 12-140-385 | 818 | 24 | N | | |
| UGT1A7 | 12-141-159 | 819 | 24 | Y | T | 37.5 |
| UGT1A7 | 12-141-392 | 820 | 24 | N | | |
| UGT1A7 | 12-142-315 | 821 | 24 | N | | |
| UGT1A7 | 12-142-321 | 822 | 24 | Y | G | 45.56 |
| UGT1A7 | 12-143-453 | 823 | 24 | Y | G | 49.39 |
| UGT1A7 | 12-144-169 | 824 | 24 | N | | |
| UGT1A7 | 12-144-33 | 825 | 24 | N | | |
| UGT1A7 | 12-146-174 | 826 | 24 | N | | |
| UGT1A7 | 12-146-47 | 827 | 24 | N | | |
| UGT1A7 | 12-148-283 | 828 | 24 | N | | |
| UGT1A7 | 12-148-311 | 829 | 24 | Y | T | 43.17 |
| UGT1A7 | 12-149-320 | 830 | 24 | N | | |
| UGT1A7 | 12-151-174 | 831 | 24 | N | | |
| UGT1A7 | 12-151-196 | 832 | 24 | N | | |
| UGT1A7 | 12-151-270 | 833 | 24 | N | | |
| UGT1A7 | 12-152-453 | 834 | 24 | N | | |
| UGT1A7 | 12-153-116 | 835 | 24 | Y | T | 37.78 |

TABLE 11B-continued

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| UGT1A7 | 12-154-480 | 836 | 24 | N | | |
| UGT1A7 | 12-155-403 | 837 | 24 | N | | |
| UGT1A7 | 12-156-91 | 838 | 24 | Y | A | 50 |
| UGT1A7 | 12-157-437 | 839 | 24 | N | | |
| UGT1A7 | 12-158-213 | 840 | 24 | N | | |
| UGT1A7 | 12-158-450 | 841 | 24 | N | | |
| UGT1A7 | 12-161-157 | 842 | 24 | N | | |
| UGT1A7 | 12-162-21 | 843 | 24 | N | | |
| UGT2B4 | 10-470-25 | 844 | 24 | Y | T | 44.44 |
| UGT2B4 | 10-471-84 | 845 | 24 | Y | A | 27.17 |
| UGT2B4 | 10-471-85 | 846 | 24 | Y | | |
| UGT2B4 | 10-473-333 | 848 | 24 | N | | |
| UGT2B4 | 10-494-284 | 849 | 24 | N | | |
| UGT2B4 | 12-637-219 | 850 | 24 | Y | G | 36.17 |
| UGT2B4 | 12-639-95 | 851 | 24 | Y | G | 34.95 |
| UGT2B4 | 12-639-241 | 852 | 24 | N | | |
| UGT2B4 | 12-640-151 | 853 | 24 | N | | |
| UGT2B4 | 12-640-296 | 854 | 24 | N | | |
| UGT2B4 | 12-640-325 | 855 | 24 | Y | | |
| UGT2B4 | 12-640-413 | 856 | 24 | N | | |
| UGT2B4 | 12-641-120 | 857 | 24 | N | | |
| UGT2B4 | 12-641-122 | 858 | 24 | N | | |
| UGT2B4 | 12-641-223 | 859 | 24 | N | | |
| UGT2B4 | 12-641-267 | 860 | 24 | N | | |
| UGT2B4 | 12-642-387 | 861 | 24 | N | | |
| UGT2B4 | 12-642-417 | 862 | 24 | Y | G | 26.51 |
| UGT2B4 | 12-646-429 | 863 | 24 | N | | |
| UGT2B4 | 12-646-433 | 864 | 24 | N | | |
| UGT2B4 | 12-647-145 | 865 | 24 | N | | |
| UGT2B4 | 12-648-123 | 866 | 24 | N | | |
| UGT2B4 | 12-648-300 | 867 | 24 | Y | T | 37.91 |
| UGT2B4 | 12-648-402 | 868 | 24 | N | | |
| UGT2B4 | 12-652-115 | 869 | 24 | N | | |
| UGT2B4 | 12-652-203 | 870 | 24 | Y | C | 42.47 |
| UGT2B4 | 12-652-274 | 871 | 24 | N | | |
| UGT2B4 | 12-652-371 | 872 | 24 | N | | |
| UGT2B4 | 12-653-423 | 873 | 24 | N | | |
| UGT2B4 | 12-654-115 | 874 | 24 | N | | |
| UGT2B4 | 12-654-207 | 875 | 24 | N | | |
| UGT2B4 | 12-657-396 | 876 | 24 | N | | |
| UGT2B4 | 12-658-120 | 877 | 24 | N | | |
| UGT2B4 | 12-659-382 | 878 | 24 | N | | |
| UGT2B4 | 12-660-134 | 879 | 24 | N | | |
| UGT2B4 | 12-662-80 | 880 | 24 | N | | |
| UGT2B7 | 12-906-149 | 881 | 24 | Y | | |
| UGT2B7 | 12-906-154 | 882 | 24 | N | | |
| UGT2B7 | 12-906-251 | 883 | 24 | N | | |
| UGT2B7 | 12-906-451 | 884 | 24 | N | | |
| UGT2B7 | 12-907-199 | 885 | 24 | Y | G | 3.23 |
| UGT2B7 | 12-9070482 | 886 | 24 | N | | |
| UGT2B7 | 12-909-36 | 887 | 24 | N | | |
| UGT2B7 | 12-909-176 | 888 | 24 | N | | |
| UGT2B7 | 12-909-484 | 889 | 24 | N | | |
| UGT2B7 | 12-910-76 | 890 | 24 | Y | A | 23.91 |
| UGT2B7 | 12-910-295 | 891 | 24 | N | | |
| UGT2B7 | 12-911-22 | 892 | 24 | Y | C | 43.96 |
| UGT2B7 | 12-912-65 | 893 | 24 | N | | |
| UGT2B7 | 12-914-106 | 894 | 24 | Y | C | 44.62 |
| UGT2B7 | 12-914-252 | 895 | 24 | N | | |
| UGT2B10 | 10-448-266 | 896 | 24 | N | | |
| UGT2B10 | 10-453-330 | 897 | 24 | N | | |
| UGT2B10 | 10-455-367 | 898 | 24 | N | | |
| UGT2B10 | 12-5-158 | 899 | 24 | Y | T | 11.8 |
| UGT2B10 | 12-9-367 | 900 | 24 | Y | A | 14.67 |
| UGT2B10 | 12-10-303 | 901 | 24 | Y | T | 14.67 |
| UGT2B10 | 12-14-264 | 902 | 24 | Y | T | 14.29 |
| UGT2B10 | 12-17-86 | 903 | 24 | Y | A | 44.02 |
| UGT2B10 | 12-19-163 | 904 | 24 | Y | G | 29.89 |
| UGT2B15 | 10-457-284 | 905 | 24 | N | | |
| UGT2B15 | 10-460-221 | 906 | 24 | N | | |
| UGT2B15 | 10-460-232 | 907 | 24 | N | | |
| UGT2B15 | 10-460-235 | 908 | 24 | N | | |
| UGT2B15 | 10-460-236 | 909 | 24 | N | | |
| UGT2B15 | 10-460-285 | 910 | 24 | N | | |

TABLE 11B-continued

| GENE | BIALLELIC MARKER ID | SEQ ID NO. | BIALLELIC MARKER POSITION IN SEQ ID NO. | VALIDATION MICRO-SEQUENCING | GENOTYPING LEAST COMMON ALLELE | FREQUENCY % |
|---|---|---|---|---|---|---|
| UGT2B15 | 12-605-58 | 911 | 24 | Y | T | 47.67 |
| UGT2B15 | 12-607-207 | 912 | 24 | N | | |
| UGT2B15 | 12-609-119 | 913 | 24 | Y | T | 45.11 |
| UGT2B15 | 12-609-180 | 914 | 24 | N | | |
| UGT2B15 | 12-609-233 | 915 | 24 | N | | |
| UGT2B15 | 12-611-294 | 916 | 24 | Y | A | 43.26 |
| UGT2B15 | 12-612-41 | 917 | 24 | Y | C | 28.65 |
| UGT2B15 | 12-613-302 | 918 | 24 | N | | |
| UGT2B15 | 12-614-471 | 919 | 24 | Y | T | 39.44 |
| UGT2B15 | 12-620-192 | 920 | 24 | Y | T | 30.36 |
| UGT2B15 | 12-621-49 | 921 | 24 | N | | |
| UGT2B15 | 12-622-325 | 922 | 24 | N | | |
| UGT2B15 | 12-624-82 | 923 | 24 | N | | |
| UGT2B15 | 12-624-83 | 924 | 24 | N | | |
| UGT2B15 | 12-624-107 | 925 | 24 | N | | |
| UGT2B15 | 12-624-146 | 926 | 24 | N | | |
| UGT2B15 | 12-624-288 | 927 | 24 | N | | |
| UGT2B15 | 12-624-293 | 928 | 24 | N | | |
| MGST2 | 12-421-135 | 929 | 24 | N | | |
| MGST2 | 12-442-133 | 930 | 24 | Y | C | 5.85 |
| MGST2 | 12-449-63 | 931 | 24 | N | | |
| MGST2 | 12-454-242 | 932 | 24 | N | | |
| MGST2 | 12-463-250 | 933 | 24 | N | | |
| MGST2 | 12-462-199 | 934 | 24 | N | | |
| DME | 10-430-287 | 935 | 24 | N | | |
| DME | 12-718-432 | 936 | 24 | N | | |
| CYP3A4–CYP3A7 | 12-269-301 | 937 | 24 | Y | | |
| FMO | 2-13-398 | 938 | 24 | N | | |
| FMO | 2-28-132 | 939 | 24 | N | | |
| FMO | 2-39-27 | 940 | 24 | N | | |
| FMO | 2-45-155 | 941 | 24 | N | | |
| FMO | 2-4-391 | 942 | 24 | N | | |
| GSHS | 10-345-410 | 943 | 24 | N | | |
| GLCL | 10-358-353 | 944 | 24 | N | | |
| GLCL | 10-360-190 | 945 | 24 | N | | |
| GLCL | 10-365-374 | 946 | 24 | N | | |
| GLCL | 10-367-58 | 947 | 24 | N | | |
| GLCL | 12-468-424 | 948 | 24 | N | | |
| GLCL | 12-481-293 | 949 | 24 | N | | |
| GLCL | 12-499-86 | 950 | 24 | N | | |
| GLCL | 12-500-217 | 951 | 24 | N | | |
| GLCL | 12-511-101 | 952 | 24 | N | | |
| 6PGD | 12-586-443 | 953 | 24 | N | | |
| 6PGD | 12-593-287 | 954 | 24 | N | | |
| 6PGD | 12-795-383 | 955 | 24 | N | | |
| UGT2B4 | 10-494-332 | 956 | 24 | N | | |
| UGT2B4 | 12-659-251 | 958 | 24 | N | | |
| UGT2B7 | 12-912-419 | 959 | 24 | N | | |
| UGT2B7 | 12-914-28 | 960 | 24 | N | | |
| UGT2B15 | 12-624-307 | 961 | 24 | N | | |
| MGST2 | 10-290-326 | 962 | 24 | N | | |
| MGST2 | 10-290-37 | 963 | 24 | N | | |
| MGST2 | 10-523-232 | 964 | 24 | N | | |
| MGST2 | 12-449-300 | 965 | 24 | N | | |
| G6PDH | 10-186-212 | 966 | 24 | N | | |
| MGST2 | 10-286-289 | 967 | 24 | N | | |
| MGST2 | 10-286-345 | 968 | 24 | N | | |
| MGST2 | 10-286-375 | 969 | 24 | N | | |
| MGST2 | 10-289-201 | 970 | 24 | N | | |
| GGT5 | 10-321-28 | 971 | 24 | N | | |
| CYP1A2 | 10-98-265 | 972 | 24 | N | | |
| UGT1A7 | 12-157-115 | 973 | 24 | N | | |
| GLCL | 12-472-48 | 974 | 24 | N | | |
| GLCL | 12-477-151 | 975 | 24 | N | | |
| GLCL | 12-479-214 | 976 | 24 | N | | |
| MGST2 | 10-290-328 | 977 | 24 | N | | |

TABLE 12

| SEQ ID NO. | BIALLELIC MARKER ID | 1ST ALLELE | 2ND ALLELE | POSITION RANGE OF PREFERRED SEQUENCES |
|---|---|---|---|---|
| 1 | 12-421-140 | A | G | 1–1001 |
| 2 | 12-424-192 | A | G | 190–801; 865–999 |
| 3 | 12-424-198 | G | T | 184–795; 859–993 |
| 4 | 12-425-57 | G | A | 208–225; 266–478 |
| 5 | 12-426-154 | A | G | 152–961 |
| 6 | 12-429-198 | C | T | 260–784; 822–1001 |
| 7 | 12-430-80 | T | C | 1–996 |
| 8 | 12-433-215 | A | G | 1–1001 |
| 12 | 12-447-58 | G | C | 1–36; 390–914 |
| 13 | 12-453-429 | C | T | 1–1001 |
| 14 | 12-454-363 | A | G | 1–315; 377–466; 598–619 |
| 15 | 12-455-326 | T | C | 1–357; 391–594; 760–827 |
| 16 | 12-455-383 | G | A | 1–414; 448–651; 817–884 |
| 17 | 12-456-269 | A | G | 1–536 |
| 19 | 12-457-204 | A | G | 437–527; 761–1001 |
| 20 | 12-457-206 | C | T | 435–525; 759–1001 |
| 21 | 12-458-196 | T | A | 1–727 |
| 22 | 12-458-438 | T | C | 1–21; 298–1001 |
| 23 | 12-460-274 | A | G | 1–499; 563–1001 |
| 24 | 12-461-124 | A | C | 1–203; 259–644; 687–773; 807–833 |
| 25 | 12-461-299 | C | T | 1–28; 84–469; 512–591 |
| 26 | 12-461-465 | C | T | 1–303; 346–432 |
| 27 | 12-462-280 | C | T | 1–1001 |
| 28 | 12-464-66 | G | T | 1–215; 261–1001 |
| 29 | 12-465-26 | C | T | 1–61; 99–1001 |
| 30 | 12-465-234 | G | T | 1–1001 |
| 31 | 10-428-219 | A | G | 1–398; 506–1000 |
| 33 | 10-420-284 | C | T | 1–302; 472–772 |
| 34 | 10-423-411 | C | T | 1–227; 333–821 |
| 35 | 12-713-95 | C | T | 1–668 |
| 36 | 12-713-149 | G | C | 1–668 |
| 37 | 12-716-295 | C | T | 1–902 |
| 38 | 12-720-80 | G | C | 1–982 |
| 40 | 12-721-281 | A | C | 1–926 |
| 41 | 12-721-440 | A | G | 1–1000 |
| 42 | 12-723-293 | C | T | 1–1001 |
| 43 | 12-724-195 | C | T | 277–1001 |
| 44 | 12-724-225 | C | T | 245–1001 |
| 49 | 10-413-394 | A | G | 1–139; 831–1001 |
| 51 | 10-416-273 | A | T | 1–258; 855–1001 |
| 53 | 12-665-315 | T | C | 180–1001 |
| 54 | 12-666-324 | A | C | 338–375; 414–501; 581–611 |
| 78 | 12-244-275 | A | G | |
| 79 | 12-251-153 | A | C | 1–111; 158–950 |
| 82 | 12-265-300 | T | C | 1–999 |
| 84 | 12-272-112 | A | C | 396–416 |
| 85 | 10-216-182 | A | G | 77–151; 186–235; 320–488; 733–761 |
| 86 | 10-217-91 | C | T | 1–189; 434–462; 810–871; 925–1001 |
| 101 | 2-10-107 | C | T | 260–450 |
| 102 | 2-10-378 | A | G | 260–450 |
| 104 | 2-11-156 | A | C | 369–387 |
| 105 | 2-11-379 | A | G | 369–387 |
| 121 | 2-29-166 | C | T | |
| 141 | 10-436-43 | G | C | 1–630; 794–1001 |
| 142 | 10-436-376 | A | G | 1–297; 461–642; 977–1001 |
| 143 | 10-431-51 | A | C | 329–534; 682–860 |
| 144 | 10-432-93 | A | G | 1–40; 374–559; 705–885 |
| 146 | 10-260-282 | G | T | 1–24; 95–324; 482–1001 |
| 147 | 10-263-26 | A | C | 1–632; 754–1001 |
| 148 | 10-258-408 | A | G | 337–668 |
| 149 | 12-317-259 | G | A | 1–44; 116–150; 181–241; 281–673; 968–1001 |
| 150 | 12-323-385 | T | C | 340–1001 |
| 152 | 12-324-335 | G | C | 1–176; 395–906 |
| 153 | 12-324-380 | A | G | 1–159; 378–889 |
| 154 | 12-325-30 | C | T | 272–837; 977–1001 |
| 155 | 12-327-31 | G | T | 1–570; 655–821; 875–922; 973–999 |
| 156 | 12-327-415 | A | G | 1–208; 293–459; 513–1001 |
| 157 | 12-331-270 | G | A | 1–531; 834–1001 |
| 158 | 12-331-275 | T | G | 125–536; 839–1001 |
| 159 | 12-334-320 | A | G | 68–705 |
| 160 | 12-334-391 | A | G | 1–634; 982–1001 |
| 161 | 12-335-417 | G | C | 239–1001 |
| 162 | 12-337-189 | A | G | 1–1001 |
| 163 | 12-340-130 | A | G | 196–881 |
| 164 | 12-340-210 | C | T | 196–961 |
| 165 | 12-340-222 | G | T | 196–973 |
| 166 | 12-340-240 | C | T | 196–975 |
| 167 | 12-341-99 | A | G | 1–1001 |
| 168 | 12-342-32 | T | C | 238–397; 859–960 |
| 169 | 12-344-349 | G | T | 365–1001 |
| 170 | 12-345-453 | G | C | 1–606 |
| 192 | 12-475-446 | G | A | |
| 228 | 10-325-311 | A | G | 41–312; 421–891 |
| 231 | 10-331-357 | G | T | 76–218; 373–730; 938–1001 |
| 232 | 10-334-263 | A | G | 1–359; 481–604; 781–893 |
| 235 | 12-185-78 | C | T | 1–1001 |
| 236 | 12-186-154 | A | G | 335–876 |
| 237 | 12-186-397 | C | T | 92–633; 967–1001 |
| 238 | 12-187-65 | C | T | 345–846 |
| 239 | 12-187-66 | A | G | 344–845 |
| 240 | 12-189-348 | G | A | 281–358; 407–1001 |
| 246 | 12-194-135 | G | T | 543–1001 |
| 247 | 12-194-325 | A | G | 351–1001 |
| 248 | 12-194-337 | A | G | 339–1001 |
| 249 | 12-194-479 | C | T | 197–1001 |
| 251 | 10-444-248 | A | G | |
| 254 | 12-670-48 | G | C | 1–961 |
| 255 | 12-670-91 | C | T | 1–918 |
| 256 | 12-670-157 | C | T | 1–852 |
| 257 | 12-671-148 | C | T | 1–908 |
| 258 | 12-679-245 | A | G | 96–465 |
| 259 | 12-679-371 | A | G | 96–465 |
| 260 | 12-679-426 | A | C | 96–465 |
| 265 | 12-586-414 | A | G | 1–71; 149–929 |
| 268 | 12-589-152 | T | G | 164–1001 |
| 269 | 12-592-118 | A | T | 353–1001 |
| 270 | 12-593-174 | T | C | 342–815 |
| 271 | 12-596-124 | A | G | 1–742 |
| 272 | 12-602-196 | C | T | 1–240; 436–641 |
| 274 | 12-603-191 | T | C | 1–709 |
| 275 | 12-783-73 | G | C | 1–769; 981–1001 |
| 277 | 12-785-200 | C | T | 351–510 |
| 279 | 12-787-103 | G | A | 1–47; 232–324; 401–1001 |
| 280 | 12-790-396 | G | A | 47–64; 393–1001 |
| 281 | 12-791-211 | A | G | 1–379; 467–818 |
| 284 | 12-803-125 | T | A | 125–1001 |
| 285 | 12-805-115 | G | A | 1–66; 278–838; 959–1001 |
| 286 | 12-808-52 | A | G | 400–1001 |
| 287 | 12-808-75 | G | C | 377–1001 |
| 289 | 12-810-77 | G | A | 99–1001 |
| 293 | 10-405-54 | C | T | 1–492 |
| 297 | 10-410-274 | A | C | 643–805 |
| 301 | 12-122-341 | C | T | 1–23; 150–282; 324–435; 593–620 |
| 302 | 12-122-381 | A | C | 110–242; 284–395; 553–580 |
| 303 | 12-124-169 | G | T | 1–727; 788–1001 |
| 304 | 12-124-194 | C | T | 1–702; 763–1001 |
| 305 | 12-124-300 | G | T | 1–596; 657–1001 |
| 306 | 12-124-58 | A | C | 1–837; 898–1001 |
| 308 | 12-126-297 | T | C | 1–508; 944–1001 |
| 310 | 12-129-176 | G | T | 163–1001 |

TABLE 12-continued

| SEQ ID NO. | BIALLELIC MARKER ID | 1ST ALLELE | 2ND ALLELE | POSITION RANGE OF PREFERRED SEQUENCES |
|---|---|---|---|---|
| 313 | 12-131-112 | T | C | 254–422 |
| 315 | 12-132-437 | A | C | 258–991 |
| 316 | 12-133-153 | T | C | 1–515; 607–666; 775–918; 976–1001 |
| 317 | 12-133-318 | T | A | 1–515; 607–666; 775–918; 976–1001 |
| 318 | 12-136-238 | A | G | 1–643 |
| 319 | 12-138-141 | G | A | 1–393; 521–651 |
| 320 | 12-138-42 | T | G | 1–294; 422–552 |
| 321 | 12-138-67 | G | A | 1–319; 447–577 |
| 322 | 12-139-380 | A | G | 94–157; 276–663 |
| 323 | 12-140-134 | G | T | 1–142; 212–951 |
| 324 | 12-140-329 | C | T | 1–756 |
| 325 | 12-140-385 | G | C | 1–700 |
| 326 | 12-141-159 | T | C | 1–1001 |
| 327 | 12-141-392 | C | A | 1–1001 |
| 328 | 12-142-315 | A | G | 1–1001 |
| 329 | 12-142-321 | A | G | 1–1001 |
| 330 | 12-143-453 | A | G | 1–1001 |
| 331 | 12-144-169 | G | A | 97–1001 |
| 332 | 12-144-33 | G | A | 1–1001 |
| 333 | 12-146-174 | T | C | 1–529; 765–805 |
| 336 | 12-148-311 | T | C | 1–251; 684–1001 |
| 337 | 12-149-320 | T | C | 202–1001 |
| 338 | 12-151-174 | G | T | 313–1001 |
| 339 | 12-151-196 | C | T | 291–1001 |
| 340 | 12-151-270 | A | G | 217–1001 |
| 341 | 12-152-453 | C | T | 1–239; 526–576; 623–1001 |
| 342 | 12-153-116 | C | T | 1–819; 866–1001 |
| 346 | 12-157-437 | A | C | 1–865 |
| 347 | 12-158-213 | T | C | 1–1001 |
| 348 | 12-158-450 | T | G | 206–980 |
| 350 | 12-162-21 | A | G | 1–998 |
| 351 | 10-470-25 | A | T | 1–339; 413–539; 730–1001 |
| 355 | 10-473-333 | C | T | 461–744 |
| 356 | 10-494-284 | C | T | 89–349; 450–513 |
| 359 | 12-639-241 | T | G | 1–199; 652–667; 742–763 |
| 360 | 12-640-151 | G | A | 1–806; 943–1001 |
| 361 | 12-640-296 | T | G | 1–862 |
| 362 | 12-640-325 | T | C | 1–1001 |
| 363 | 12-640-413 | C | G | 1–1001 |
| 364 | 12-641-120 | G | A | 98–1001 |
| 365 | 12-641-122 | T | G | 100–1001 |
| 366 | 12-641-223 | G | A | 1–15; 134–1001 |
| 367 | 12-641-267 | T | C | 1–15; 134–1001 |
| 368 | 12-642-387 | A | G | 1–224; 292–1001 |
| 369 | 12-642-417 | A | G | 1–194; 262–1001 |
| 372 | 12-647-145 | A | G | 1–898 |
| 373 | 12-648-123 | A | G | 1–751 |
| 374 | 12-648-300 | C | T | 1–839 |
| 375 | 12-648-402 | G | C | 1–810; 909–1001 |
| 376 | 12-652-115 | C | T | 1–30; 191–798 |
| 377 | 12-652-203 | A | C | 1–30; 191–886 |
| 378 | 12-652-274 | G | T | 1–30; 191–957 |
| 379 | 12-652-371 | C | T | 138–1001 |
| 380 | 12-653-423 | T | A | 1–603 |
| 381 | 12-654-115 | T | C | 161–1001 |
| 382 | 12-654-207 | G | A | 1–95; 253–1001 |
| 383 | 12-657-396 | A | G | 329–1001 |
| 384 | 12-658-120 | A | T | 1–1001 |
| 385 | 12-659-382 | A | G | 1–1001 |
| 386 | 12-660-134 | A | G | 291–608; 886–983 |
| 387 | 12-662-80 | G | C | 480–1001 |
| 391 | 12-906-451 | A | C | 447–532; 865–1001 |
| 392 | 12-907-199 | G | T |  |
| 394 | 12-909-36 | A | G |  |
| 397 | 12-910-76 | A | G | 1–785; 854–870 |
| 398 | 12-910-295 | C | T | 1–1001 |
| 399 | 12-911-22 | G | C | 1–740 |
| 400 | 12-912-65 | C | T | 1–183; 290–1001 |
| 401 | 12-914-106 | C | T | 1–1001 |
| 402 | 12-914-252 | A | T | 1–1001 |
| 404 | 10-453-330 | C | T | 1–207; 761–1001 |
| 406 | 12-5-158 | C | T | 672–1001 |
| 407 | 12-9-367 | G | A | 1–15; 249–283; 400–425; 493–666; 722–1001 |
| 409 | 12-14-264 | C | T | 1–1001 |
| 410 | 12-17-86 | T | A | 1–1001 |
| 411 | 12-19-163 | A | G | 230–388; 525–709; 824–866 |
| 414 | 10-460-232 | A | G | 1–349; 521–1001 |
| 415 | 10-460-235 | C | T | 1–346; 518–1001 |
| 416 | 10-460-236 | A | G | 1–345; 517–1001 |
| 417 | 10-460-285 | A | T | 1–296; 468–1001 |
| 418 | 12-605-58 | G | T | 1–1001 |
| 419 | 12-607-207 | G | A | 1–746; 885–902 |
| 420 | 12-609-119 | T | G | 1–234; 294–1001 |
| 421 | 12-609-180 | T | G | 40–295; 355–1001 |
| 422 | 12-609-233 | G | A | 138–348; 404–1001 |
| 423 | 12-611-294 | G | A | 1–617; 895–967 |
| 424 | 12-612-41 | C | T | 1–56; 398–708 |
| 425 | 12-613-302 | C | G | 1–86; 336–1001 |
| 426 | 12-614-471 | T | A | 1–1001 |
| 427 | 12-620-192 | G | T | 318–1001 |
| 428 | 12-621-49 | A | G | 1–242; 451–815 |
| 429 | 12-622-325 | C | T |  |
| 430 | 12-624-82 | T | C | 1–1001 |
| 431 | 12-624-83 | G | A | 1–1061 |
| 432 | 12-624-107 | T | C | 1–989 |
| 433 | 12-624-146 | T | C | 1–1001 |
| 434 | 12-624-288 | T | G | 1–1001 |
| 435 | 12-624-293 | T | C | 1–1001 |
| 436 | 12-421-135 | T | — | 1–1001 |
| 438 | 12-449-63 | AT | — | 1–107; 314–656 |
| 439 | 12-454-242 | AT | — | 1–436; 498–587; 719–740 |
| 440 | 12-463-250 | CAT | — | 1–30; 102–601; 752–1001 |
| 441 | 12-462-199 |  | deletion | 1–1001 |
| 442 | 10-430-287 | T | — | 1–330; 442–740; 782–1001 |
| 443 | 12-718-432 | T | — | 1–1001 |
| 444 | 12-269-301 | T | — | 774–820 |
| 450 | 12-345-410 |  | deletion | 1–649 |
| 460 | 12-586-443 | C | — | 1–42; 120–911 |
| 461 | 12-593-287 |  | deletion | 1–17; 455–942 |
| 462 | 12-795-383 |  | insertion | 166–500; 540–1001 |
| 465 | 12-659-251 | deletion | — | 1–929 |
| 466 | 12-912-419 | A | — | 1–686 |
| 467 | 12-914-28 | T | — | 1–806 |
| 468 | 12-624-307 | T | — | 1–1001 |
| 469 | 10-290-326 | A | G | 1–197; 437–1000 |
| 472 | 12-449-300 | T | C | 1–542; 908–1000 |
| 484 | 10-290-328 | deletion |  | 1–194; 434–1000 |

TABLE 13

| SEQ ID NO. | BIALLELIC MARKER ID | ORIGINAL ALLELE | ALTERNATIVE ALLELE |
|---|---|---|---|
| 10 | 12-441-343 | G | A |
| 18 | 12-456-380 | G | T |
| 32 | 10-429-84 | T | C |
| 45 | 10-153-329 | T | G |
| 46 | 10-95-342 | G | A |
| 47 | 10-100-277 | T | C |
| 57 | 10-76-217 | C | T |
| 59 | 10-77-316 | A | T |
| 60 | 10-155-78 | T | C |
| 61 | 10-155-104 | C | G |
| 62 | 10-156-52 | G | A |
| 63 | 10-157-39 | C | T |
| 64 | 10-157-131 | A | G |

TABLE 13-continued

| SEQ ID NO. | BIALLELIC MARKER ID | ORIGINAL ALLELE | ALTERNATIVE ALLELE |
|---|---|---|---|
| 65 | 10-157-166 | G | A |
| 66 | 10-157-246 | G | A |
| 67 | 10-159-161 | T | A |
| 68 | 10-159-162 | C | A |
| 69 | 10-83-169 | T | C |
| 70 | 10-84-152 | C | T |
| 71 | 10-84-243 | C | T |
| 74 | 10-85-43 | C | T |
| 76 | 10-85-320 | A | T |
| 81 | 12-254-180 | G | A |
| 83 | 12-271-118 | T | C |
| 87 | 10-213-292 | C | G |
| 90 | 2-1-216 | G | A |
| 91 | 2-1-397 | T | C |
| 92 | 2-3-232 | C | T |
| 93 | 2-4-51 | A | C |
| 94 | 2-4-126 | A | G |
| 95 | 2-5-202 | A | G |
| 96 | 2-5-275 | G | A |
| 97 | 2-5-346 | C | T |
| 98 | 2-8-171 | A | G |
| 99 | 2-9-188 | G | A |
| 100 | 2-9-223 | T | G |
| 103 | 2-11-284 | A | G |
| 106 | 2-12-223 | A | T |
| 107 | 2-14-239 | C | T |
| 108 | 2-14-370 | C | |
| 109 | 2-17-104 | A | G |
| 110 | 2-17-396 | A | C |
| 111 | 2-22-43 | A | G |
| 112 | 2-22-138 | G | A |
| 113 | 2-23-82 | A | G |
| 114 | 2-23-166 | G | A |
| 115 | 2-23-244 | G | T |
| 116 | 2-24-115 | C | T |
| 117 | 2-25-36 | G | C |
| 118 | 2-27-185 | G | A |
| 119 | 2-27-378 | G | C |
| 120 | 2-29-142 | G | A |
| 124 | 2-29-314 | C | T |
| 125 | 2-32-68 | A | G |
| 126 | 2-35-357 | T | C |
| 127 | 2-36-256 | G | C |
| 128 | 2-36-354 | A | C |
| 129 | 2-42-236 | C | T |
| 130 | 2-43-139 | G | A |
| 131 | 2-44-215 | C | T |
| 132 | 2-45-38 | C | T |
| 133 | 2-45-183 | T | C |
| 134 | 2-45-335 | T | A |
| 135 | 2-45-394 | C | T |
| 136 | 2-48-39 | A | G |
| 137 | 2-48-72 | C | T |
| 138 | 2-48-156 | T | G |
| 139 | 2-48-285 | A | G |
| 140 | 2-49-167 | A | G |
| 151 | 12-324-219 | C | T |
| 171 | 12-346-204 | G | A |
| 172 | 10-364-55 | T | G |
| 173 | 10-364-108 | T | C |
| 174 | 10-364-267 | T | A |
| 175 | 10-367-20 | T | G |
| 176 | 10-351-389 | A | G |
| 177 | 10-353-102 | T | A |
| 178 | 12-474-346 | G | A |
| 179 | 10-354-320 | G | A |
| 180 | 10-354-360 | A | G |
| 181 | 10-355-87 | G | A |
| 182 | 10-358-60 | G | A |
| 183 | 12-468-63 | T | C |
| 184 | 12468-388 | T | C |
| 185 | 12468-491 | G | A |
| 186 | 12-469-132 | T | C |
| 187 | 12-469-245 | G | A |
| 188 | 12-472-435 | G | A |
| 189 | 12-473-311 | A | C |
| 190 | 12-473-483 | T | C |
| 191 | 12-475-85 | G | T |
| 193 | 12-477-100 | A | G |
| 194 | 12-477-331 | G | A |
| 195 | 12-477-332 | T | C |
| 196 | 12-477-44 | C | G |
| 197 | 12-478-223 | G | A |
| 198 | 12-478-320 | G | A |
| 199 | 12-479-289 | G | T |
| 200 | 12-482-237 | A | G |
| 201 | 12-482-285 | T | A |
| 202 | 12-482-482 | A | T |
| 203 | 12-483-322 | A | T |
| 204 | 12-484-46 | G | A |
| 205 | 12-490-312 | A | T |
| 206 | 12-491-295 | A | G |
| 207 | 12-493-417 | G | C |
| 208 | 12-494-373 | C | T |
| 209 | 12-495-166 | C | T |
| 210 | 12-495-272 | A | T |
| 211 | 12-495-424 | T | C |
| 212 | 12-500-220 | A | G |
| 213 | 12-501-155 | G | T |
| 214 | 12-503-52 | T | G |
| 215 | 12-503-62 | T | A |
| 216 | 12-504-54 | G | A |
| 217 | 12-504-96 | C | T |
| 218 | 12-504-428 | G | C |
| 219 | 12-507-53 | T | C |
| 220 | 12-507-92 | A | G |
| 221 | 12-507-159 | T | G |
| 222 | 12-507-177 | C | G |
| 223 | 12-508-29 | G | A |
| 224 | 12-509-42 | G | A |
| 225 | 12-509-126 | G | A |
| 226 | 12-510-59 | G | A |
| 227 | 12-511-74 | T | C |
| 229 | 10-327-120 | C | T |
| 230 | 10-331-179 | G | A |
| 233 | 10-321-226 | A | G |
| 234 | 12-183-98 | G | A/T |
| 241 | 12-192-63 | C | G/T |
| 243 | 12-192-268 | G | C |
| 245 | 12-192-352 | G | A |
| 250 | 10-442-133 | G | C |
| 252 | 10-445-281 | C | T |
| 253 | 12-668-362 | T | A |
| 261 | 12-680-331 | C | T |
| 262 | 10-151-154 | G | A |
| 264 | 10-138-352 | T | C |
| 266 | 12-587-379 | A | C |
| 267 | 12-588-103 | G | A |
| 273 | 12-602-350 | C | A |
| 278 | 12-785-393 | G | A |
| 283 | 12-793-383 | T | G |
| 288 | 12-809-119 | C | G |
| 290 | 10-265-178 | G | A |
| 292 | 10-403-312 | C | T |
| 298 | 10-410-280 | C | T |
| 299 | 10-410-337 | A | G |
| 300 | 12-121-326 | G | A |
| 307 | 12-126-222 | C | T |
| 309 | 12-128-225 | G | T |
| 312 | 12-130-260 | C | T |
| 314 | 12-132-157 | T | C |
| 334 | 12-146-47 | A | G |
| 335 | 12-148-283 | G | A |
| 343 | 12-154-480 | C | T |
| 344 | 12-155-403 | C | A |
| 349 | 12-161-157 | G | A |
| 358 | 1 2-639-95 | G | A |
| 370 | 12-646-429 | T | C |
| 371 | 12-646-433 | T | G |
| 388 | 12-906-149 | G | A |
| 389 | 12-906-154 | A | C |
| 390 | 12-906-251 | A | T |

TABLE 13-continued

| SEQ ID NO. | BIALLELIC MARKER ID | ORIGINAL ALLELE | ALTERNATIVE ALLELE |
|---|---|---|---|
| 395 | 12-909-176 | C | T |
| 396 | 12-909-484 | G | T |
| 403 | 10-448-266 | A | C |
| 405 | 10-455-367 | T | C |
| 408 | 12-10-303 | C | T |
| 413 | 10-460-221 | C | T |
| 437 | 12-442-133 | C | — |
| 445 | 2-13-398 | G | — |
| 446 | 2-28-132 | — | T |
| 447 | 2-39-27 | | deletion |
| 448 | 2-45-155 | | deletion |
| 449 | 2-4-391 | G | — |
| 452 | 10-360-190 | — | T |
| 453 | 10-365-374 | — | A |
| 454 | 10-367-58 | — | insertion |
| 455 | 12-468-424 | — | T |
| 457 | 12-499-86 | | deletion |
| 458 | 12-500-217 | | insertion |
| 459 | 12-511-101 | A | — |
| 463 | 10-494-332 | insertion | |
| 470 | 10-290-37 | C | T |
| 471 | 10-523-232 | C | T |
| 473 | 10-186-212 | G | C |
| 474 | 10-286-289 | C | G |
| 475 | 10-286-345 | A | T |
| 476 | 10-286-375 | A | G |
| 477 | 10-289-201 | T | C |
| 478 | 10-321-28 | G | A |
| 479 | 10-98-265 | A | G |
| 480 | 12-157-115 | T | C |
| 481 | 12-472-48 | T | G |
| 482 | 12-477-151 | A | G |
| 483 | 12-479-214 | G | T |

TABLE 14

| SEQ ID NO. | BIALLELIC MARKER ID | 1ST ALLELE | 2ND ALLELE |
|---|---|---|---|
| 9 | 12-441-233 | G | A |
| 11 | 12-442-221 | T | C |
| 48 | 10-102-294 | C | T |
| 50 | 10-414-243 | A | G |
| 52 | 10-418-177 | A | G |
| 56 | 10-76-177 | A | T |
| 58 | 10-76-333 | G | C |
| 72 | 10-84-277 | A | G |
| 73 | 10-84-295 | A | G |
| 75 | 10-85-117 | G | T |
| 77 | 10-86-121 | A | C |
| 80 | 12-254-115 | A | T |
| 88 | 10-214-279 | C | T |
| 89 | 10-214-380 | A | G |
| 122 | 2-29-205 | C | T |
| 123 | 2-29-206 | A | G |
| 145 | 12-631-208 | A | G |
| 242 | 12-192-64 | T | C |
| 244 | 12-192-334 | G | A |
| 263 | 10-138-206 | C | T |
| 276 | 12-783-421 | C | T |
| 282 | 12-792-233 | G | A |
| 291 | 10-266-203 | C | T |
| 294 | 10-408-356 | C | T |
| 295 | 10-409-148 | G | C |
| 296 | 10-409-249 | G | C |
| 311 | 12-130-203 | C | T |
| 345 | 12-156-91 | A | G |
| 352 | 10-471-84 | A | T |
| 353 | 10-471-85 | A | C |
| 357 | 12-637-219 | G | A |
| 393 | 12-907-482 | A | T |
| 472 | 10-457-284 | G | T |

TABLE 14-continued

| SEQ ID NO. | BIALLELIC MARKER ID | 1ST ALLELE | 2ND ALLELE |
|---|---|---|---|
| 451 | 10-358-353 | | deletion |
| 456 | 12-481-293 | T | — |

TABLE 15

| SEQ ID NO. | POSITION RANGE OF PREFERRED SEQUENCES |
|---|---|
| 9 | 940–1001 |
| 18 | 1425, 920–1001 |
| 32 | 1–175; 713–787 |
| 50 | 683–1001 |
| 52 | 1–450; 606–1001 |
| 58 | 732–832 |
| 59 | 612–725 |
| 87 | 717–742: 881–899; 951–1001 |
| 88 | 1–24; 276–305 |
| 103 | 369–387 |
| 129 | 433–449 |
| 145 | 152–241; 540–933 |
| 151 | 1–176; 395–857 |
| 171 | 1–98; 753–798 |
| 212 | 986–1001 |
| 229 | 1–439; 639–1001 |
| 230 | 254–396; 551–908 |
| 233 | 1–161; 283–406; 583–695; 843–1001 |
| 261 | 1–452 |
| 267 | 552–1001 |
| 273 | 1–86; 282–487; 963–1001 |
| 276 | 1–421; 633–1001 |
| 278 | 158–317; 834–1001 |
| 283 | 1–112 |
| 288 | 1–174; 252–399; 583–987 |
| 290 | 1–342; 790–1001 |
| 291 | 86–460 |
| 292 | 654–1001 |
| 298 | 637–799 |
| 299 | 580–742 |
| 300 | 1–297; 727–803 |
| 367 | 1433; 869–1001 |
| 309 | 1–17 |
| 311 | 928–953 |
| 312 | 871–896; 972–1001 |
| 314 | 289–755 |
| 334 | 1402; 638–678; 969–1001 |
| 335 | 1–223; 656–923 |
| 343 | 629–1000 |
| 349 | 98–251 960–1001 |
| 352 | 1–52; 399–436 |
| 353 | 1–52; 399–436 |
| 357 | 527–810 |
| 358 | 1–53; 506–521; 596–617 |
| 370 | 1–80; 675–1001 |
| 371 | 1–80; 675–1001 |
| 388 | 1–293; 748–833 |
| 389 | 1–288; 743–828 |
| 390 | 1–191; 646–731 |
| 403 | 745–1001 |
| 405 | 984–1001 |
| 408 | 797–897; 931–1001 |
| 412 | 1–207; 979–1001 |
| 455 | 1–22 |
| 463 | 1–299; 400–463 |
| 470 | 1–485; 725–1000 |
| 471 | 1–432; 514–1000 |
| 474 | 1–353; 656–1000 |
| 475 | 1–298; 601–1000 |
| 476 | 1–268; 571–1000 |
| 477 | 1–452; 538–1000 |
| 479 | 385–391 |
| 480 | 910–954 |
| 482 | 443–531; 730–854 |
| 483 | 347–392 |

TABLE 16

| SEQ ID NO. | POSITION RANGE OF MICROSEQUENCING PRIMERS | COMPLEMENTARY POSITION RANGE OF MICROSEQUENCING PRIMERS |
|---|---|---|
| 1 | 481–500 | 502–521 |
| 2 | 481–500 | 502–521 |
| 3 | 481–500 | 502–521 |
| 4 | 481–500 | 502–521 |
| 5 | 441–460 | 462–481 |
| 6 | 481–500 | 502–521 |
| 7 | 482–500* | 502–521 |
| 8 | 481–500 | 502–521 |
| 9 | 482–500* | 502–521 |
| 10 | 481–500 | 502–521 |
| 11 | 481–500 | 502–521 |
| 12 | 482–500* | 502–521 |
| 13 | 481–500 | 502–520* |
| 14 | 481–500 | 502–521 |
| 15 | 481–500 | 502–520* |
| 16 | 481–500 | 502–521 |
| 17 | 481–500 | 502–521 |
| 18 | 481–500 | 502–521 |
| 19 | 481–500 | 502–521 |
| 20 | 481–500 | 502–521 |
| 21 | 481–500 | 502–521 |
| 22 | 481–500 | 502–521 |
| 23 | 481–500 | 502–521 |
| 24 | 481–500 | 502–521 |
| 25 | 481–500 | 502–520* |
| 26 | 481–500 | 502–521 |
| 27 | 481–500 | 502–521 |
| 28 | 481–500 | 502–521 |
| 29 | 481–500 | 502–521 |
| 30 | 481–500 | 502–521 |
| 31 | 481–500 | 502–521 |
| 32 | 481–500 | 502–521 |
| 33 | 481–500 | 502–521 |
| 34 | 481–500 | 502–521 |
| 35 | 213–231* | 233–252 |
| 36 | 266–285 | 287–306 |
| 37 | 477–499* | 501–520 |
| 38 | 461–479* | 481–500 |
| 40 | 406–425 | 427–446 |
| 41 | 481–500 | 502–520* |
| 42 | 484–502* | 504–523 |
| 43 | 481–500 | 502–521 |
| 44 | 482–500* | 502–521 |
| 45 | 310–329 | 331–349* |
| 46 | 322–341 | 343–361* |
| 47 | 258–276* | 278–297 |
| 48 | 278–296* | 298–317 |
| 49 | 482–500* | 502–520* |
| 50 | 481–500 | 502–521 |
| 51 | 482–500* | 502–520* |
| 52 | 481–500 | 502–520* |
| 53 | 482–500* | 502–521 |
| 54 | 482–500* | 502–521 |
| 56 | 158–177 | 179–198 |
| 57 | 198–217 | 219–238 |
| 58 | 315–333* | 335–354 |
| 59 | 481–500 | 502–521 |
| 60 | 58–77 | 79–98 |
| 61 | 84–103 | 105–124 |
| 62 | 32–51 | 53–71* |
| 63 | 20–38* | 40–59 |
| 64 | 111–130 | 132–150* |
| 65 | 146–165 | 167–186 |
| 66 | 226–245 | 247–266 |
| 67 | 142–160* | 162–181 |
| 68 | 142–161 | 163–182 |
| 69 | 150–168* | 170–189 |
| 70 | 132–151 | 153–172 |
| 71 | 224–242* | 244–263 |
| 72 | 257–276 | 278–297 |
| 73 | 275–294 | 296–314* |
| 74 | 24–42* | 44–63 |
| 75 | 97–116 | 118–136* |
| 76 | 300–319 | 321–340 |
| 77 | 102–120* | 122–141 |
| 78 | 481–500 | 502–521 |
| 79 | 431–449* | 451–470 |
| 80 | 226–245 | 247–266 |
| 81 | 292–310* | 312–331 |
| 82 | 479–498 | 500–519 |
| 83 | 481–500 | 502–521 |
| 84 | 482–500* | 502–521 |
| 85 | 483–502 | 504–522* |
| 86 | 482–500* | 502–521 |
| 87 | 484–502* | 504–523 |
| 88 | 481–500 | 502–521 |
| 89 | 481–500 | 502 520* |
| 90 | 196–215 | 217–236 |
| 91 | 377–396 | 398–417 |
| 92 | 212–231 | 233–252 |
| 93 | 31–50 | 52–71 |
| 94 | 106–125 | 127–146 |
| 95 | 182–201 | 203–222 |
| 96 | 255–274 | 276–295 |
| 97 | 326–345 | 347–366 |
| 98 | 151–170 | 172–191 |
| 99 | 168–187 | 189–208 |
| 100 | 203–222 | 224–243 |
| 101 | 87–106 | 108–127 |
| 102 | 357–376 | 378–397 |
| 103 | 264–283 | 285–304 |
| 104 | 136–155 | 157–176 |
| 105 | 359–378 | 380–399 |
| 106 | 203–222 | 224–243 |
| 107 | 219–238 | 240–259 |
| 108 | 350–369 | 371–390 |
| 109 | 84–103 | 105–124 |
| 110 | 375–394 | 396–415 |
| 111 | 23–42 | 44–63 |
| 112 | 118–137 | 139–158 |
| 113 | 62–81 | 83–102 |
| 114 | 146–165 | 167–186 |
| 115 | 224–243 | 245–264 |
| 116 | 95–114 | 116–135 |
| 117 | 16–35 | 37–56 |
| 118 | 165–184 | 186–205 |
| 119 | 358–377 | 379–398 |
| 120 | 122–141 | 143–162 |
| 121 | 146–165 | 167–186 |
| 122 | 184–203 | 205–224 |
| 123 | 185–204 | 206–225 |
| 124 | 293–312 | 314–333 |
| 125 | 48–67 | 69–88 |
| 126 | 337–356 | 358–377 |
| 127 | 236–255 | 257–276 |
| 128 | 333–352 | 354–373 |
| 129 | 216–235 | 237–256 |
| 130 | 119–138 | 140–159 |
| 131 | 193–212 | 214–233 |
| 132 | 18–37 | 39–58 |
| 133 | 163–182 | 184–203 |
| 134 | 315–334 | 336–355 |
| 135 | 374–393 | 395–414 |
| 136 | 19–38 | 40–59 |
| 137 | 52–71 | 73–92 |
| 138 | 136–155 | 157–176 |
| 139 | 265–284 | 286–305 |
| 140 | 147–166 | 168–187 |
| 141 | 482–500* | 502–521 |
| 142 | 481–500 | 502–520* |
| 143 | 482–500* | 502–521 |
| 144 | 457–476 | 481–499* |
| 145 | 414–432* | 434–453 |
| 146 | 481–500 | 502–521 |
| 147 | 483–502 | 504–523 |
| 148 | 481–500 | 502–521 |
| 149 | 481–500 | 502–521 |
| 150 | 481–500 | 502–520* |

TABLE 16-continued

| SEQ ID NO. | POSITION RANGE OF MICROSEQUENCING PRIMERS | COMPLEMENTARY POSITION RANGE OF MICROSEQUENCING PRIMERS |
|---|---|---|
| 151 | 337–356 | 358–377 |
| 152 | 454–472* | 474–493 |
| 153 | 481–500 | 502–521 |
| 154 | 481–500 | 502–521 |
| 155 | 459–478 | 480–498* |
| 156 | 480–499 | 501–520 |
| 157 | 481–500 | 502–521 |
| 158 | 481–500 | 502–521 |
| 159 | 483–502 | 504–523 |
| 160 | 483–502 | 504–523 |
| 161 | 481–500 | 502–521 |
| 162 | 481–500 | 502–521 |
| 163 | 361–380 | 382–401 |
| 164 | 442–460* | 462–481 |
| 165 | 453–472 | 474–493 |
| 166 | 471–490 | 492–511 |
| 167 | 481–500 | 502–520* |
| 168 | 481–500 | 502–521 |
| 169 | 481–500 | 502–520* |
| 170 | 481–500 | 502–521 |
| 171 | 481–500 | 502–521 |
| 172 | 481–500 | 502–521 |
| 173 | 481–500 | 502–521 |
| 174 | 481–500 | 502–521 |
| 175 | 477–496 | 498–517 |
| 176 | 481–500 | 502–521 |
| 177 | 481–500 | 502–521 |
| 178 | 482–500* | 502–521 |
| 179 | 481–500 | 502–521 |
| 180 | 481–500 | 502–521 |
| 181 | 481–500 | 502–521 |
| 182 | 481–500 | 502–521 |
| 183 | 481–500 | 502–520* |
| 184 | 481–500 | 502–521 |
| 185 | 481–500 | 502–521 |
| 186 | 481–500 | 502–521 |
| 187 | 481–500 | 502–521 |
| 188 | 481–500 | 502–521 |
| 189 | 481–500 | 502–521 |
| 190 | 481–500 | 502–521 |
| 191 | 481–500 | 502–521 |
| 192 | 465–484 | 486–505 |
| 193 | 481–500 | 502–521 |
| 194 | 481–500 | 502–521 |
| 195 | 481–500 | 502–521 |
| 196 | 481–500 | 502–521 |
| 197 | 481–500 | 502–521 |
| 198 | 481–500 | 502–521 |
| 199 | 481–500 | 502–521 |
| 200 | 481–500 | 502–521 |
| 201 | 481–500 | 502–521 |
| 202 | 481–500 | 502–521 |
| 203 | 479–498 | 500–519 |
| 204 | 481–500 | 502–521 |
| 205 | 481–500 | 502–521 |
| 206 | 481–500 | 502–521 |
| 207 | 481–500 | 502–521 |
| 208 | 481–500 | 502–521 |
| 209 | 481–500 | 502–521 |
| 210 | 451–500 | 502–521 |
| 211 | 481–500 | 502–521 |
| 212 | 481–500 | 502–521 |
| 213 | 481–500 | 502–521 |
| 214 | 481–500 | 502–521 |
| 215 | 481–500 | 502–521 |
| 216 | 479–498 | 500–519 |
| 217 | 481–500 | 502–521 |
| 218 | 482–500* | 502–521 |
| 219 | 454–473 | 475–493* |
| 220 | 481–500 | 502–521 |
| 221 | 480–499 | 501–520 |
| 222 | 481–500 | 502–521 |
| 223 | 481–500 | 502–521 |
| 224 | 481–500 | 502–521 |
| 225 | 481–500 | 502–521 |
| 226 | 481–500 | 502–521 |
| 227 | 483–500* | 502–521 |
| 228 | 481–500 | 502–521 |
| 229 | 481–500 | 502–521 |
| 230 | 481–500 | 502–521 |
| 231 | 481–500 | 502–521 |
| 232 | 481–500 | 502–521 |
| 233 | 481–500 | 502–521 |
| 234 | 481–500 | 502–521 |
| 235 | 481–500 | 502–521 |
| 236 | 781–500 | 502–521 |
| 237 | 482–500* | 502–521 |
| 238 | 482–500* | 502–521 |
| 239 | 481–500 | 502–521 |
| 246 | 481–500 | 502–520* |
| 241 | 481–500 | 502–521 |
| 242 | 482–501 | 503–522 |
| 243 | 781–500 | 502–521 |
| 244 | 781–500 | 502–521 |
| 245 | 481–500 | 502–521 |
| 246 | 481–500 | 502–521 |
| 247 | 481–500 | 502–521 |
| 248 | 481–500 | 502–521 |
| 249 | 481–500 | 502–521 |
| 250 | 482–500* | 502–521 |
| 251 | 464–483 | 485–503* |
| 252 | 482–500* | 502–521 |
| 253 | 481–500 | 502–521 |
| 254 | 481–500 | 502–521 |
| 255 | 481–500 | 502–521 |
| 256 | 482–500* | 502–521 |
| 257 | 482–500* | 502–521 |
| 258 | 233–252 | 254–273 |
| 259 | 359–378 | 380–399 |
| 260 | 414–433 | 435–454 |
| 261 | 483–502 | 504–523 |
| 262 | 134–153 | 155–173* |
| 263 | 186–204* | 206–225 |
| 264 | 332–350* | 352–371 |
| 265 | 482–500* | 502–521 |
| 266 | 479–498 | 500–519 |
| 267 | 482–500* | 502–521 |
| 268 | 481–500 | 502–521 |
| 269 | 482–500* | 502–521 |
| 270 | 481–500 | 502–520* |
| 271 | 481–500 | 502–520* |
| 272 | 481–500 | 502–520* |
| 273 | 481–500 | 502–521 |
| 274 | 481–500 | 502–520* |
| 275 | 481–500 | 502–521 |
| 276 | 481–500 | 502–521 |
| 277 | 481–500 | 502–521 |
| 278 | 481–500 | 502–521 |
| 279 | 481–500 | 502–521 |
| 280 | 481–500 | 502–521 |
| 281 | 481–500 | 502–521 |
| 282 | 481–500 | 502–521 |
| 283 | 485–504 | 506–525 |
| 284 | 481–500 | 502–521 |
| 285 | 481–500 | 502–521 |
| 286 | 481–500 | 502–521 |
| 287 | 481–500 | 502–521 |
| 288 | 481–500 | 502–521 |
| 289 | 481–500 | 502–521 |
| 290 | 481–500 | 502–521 |
| 291 | 483–502 | 504–523 |
| 292 | 481–500 | 502–521 |
| 293 | 481–500 | 502–521 |
| 294 | 481–500 | 502–521 |
| 295 | 481–500 | 502–521 |
| 296 | 481–500 | 502–521 |
| 297 | 481–500 | 502–521 |
| 298 | 481–500 | 502–521 |

TABLE 16-continued

| SEQ ID NO. | POSITION RANGE OF MICROSEQUENCING PRIMERS | COMPLEMENTARY POSITION RANGE OF MICROSEQUENCING PRIMERS |
|---|---|---|
| 299 | 481–500 | 502–521 |
| 300 | 481–500 | 502–520* |
| 301 | 481–500 | 502–521 |
| 302 | 481–500 | 502–521 |
| 303 | 481–500 | 502–521 |
| 304 | 482–500* | 502–521 |
| 365 | 481–500 | 502–521 |
| 306 | 481–500 | 502–521 |
| 307 | 481–500 | 502–521 |
| 308 | 481–500 | 502–521 |
| 309 | 481–500 | 502–520* |
| 310 | 481–500 | 502–521 |
| 311 | 481–500 | 502–521 |
| 312 | 481–500 | 502–521 |
| 313 | 481–500 | 502–521 |
| 314 | 235–254 | 256–275 |
| 315 | 481–500 | 502–521 |
| 316 | 646–665 | 667–686 |
| 317 | 481–500 | 502–521 |
| 318 | 229–248 | 250–269 |
| 319 | 481–500 | 502–521 |
| 320 | 481–500 | 502–521 |
| 321 | 481–500 | 502–521 |
| 322 | 481–500 | 502–520* |
| 323 | 481–500 | 502–520* |
| 324 | 481–500 | 502–521 |
| 325 | 481–500 | 502–521 |
| 326 | 482–500* | 502–521 |
| 327 | 481–500 | 502–521 |
| 328 | 481–500 | 502–521 |
| 329 | 481–500 | 502–520* |
| 330 | 481–500 | 502–520 |
| 331 | 481–500 | 562–521 |
| 332 | 481–500 | 502–521 |
| 333 | 481–500 | 502–521 |
| 334 | 481–500 | 502–521 |
| 335 | 481–500 | 502–521 |
| 336 | 481–500 | 502–521* |
| 337 | 481–500 | 502–521 |
| 338 | 481–500 | 502–521 |
| 339 | 481–500 | 502–521 |
| 340 | 481–500 | 502–521 |
| 341 | 481–500 | 502–521 |
| 342 | 482–500* | 502–520* |
| 343 | 781–500 | 502–521 |
| 344 | 781–500 | 502–521 |
| 345 | 482–500* | 502–520* |
| 346 | 481–500 | 502–521 |
| 347 | 481–500 | 502–521 |
| 348 | 460–479 | 481–500 |
| 349 | 481–500 | 502–521 |
| 350 | 478–497 | 499–518 |
| 351 | 484–502* | 504–523 |
| 352 | 484–502* | 504–523 |
| 353 | 483–502 | 505–523* |
| 355 | 483–502 | 504–523 |
| 356 | 483–502 | 564–523 |
| 357 | 480–498* | 500–519 |
| 358 | 480–498* | 500–519 |
| 359 | 479–498 | 500–519 |
| 360 | 479–498 | 500–519 |
| 361 | 479–498 | 500–519 |
| 362 | 479–498 | 500–518* |
| 363 | 479–498 | 500–519 |
| 364 | 479–498 | 500–519 |
| 365 | 479–498 | 500–519 |
| 366 | 412–431 | 433–452 |
| 367 | 368–387 | 389–408 |
| 368 | 483–502 | 564–523 |
| 369 | 484–502* | 504–523 |
| 370 | 414–433 | 435–454 |
| 371 | 418–437 | 439–458 |
| 372 | 483–502 | 504–523 |
| 373 | 231–250 | 252–271 |
| 374 | 408–427 | 429–447* |
| 375 | 481–500 | 502–521 |
| 376 | 278–297 | 299–318 |
| 377 | 367–385* | 387–406 |
| 378 | 437–456 | 458–477 |
| 379 | 481–500 | 502–521 |
| 380 | 479–498 | 500–519 |
| 381 | 479–498 | 500–519 |
| 382 | 479–498 | 500–519 |
| 383 | 483–502 | 504–523 |
| 384 | 483–502 | 504–523 |
| 385 | 481–500 | 502–521 |
| 386 | 286–305 | 307–326 |
| 387 | 477–496 | 498–517 |
| 388 | 482–500* | 502–521 |
| 389 | 481–500 | 502–521 |
| 390 | 481–500 | 502–521 |
| 391 | 481–500 | 502–521 |
| 392 | 224–243 | 245–263* |
| 393 | 481–500 | 502–521 |
| 394 | 33–52 | 54–73 |
| 395 | 173–192 | 194–213 |
| 396 | 481–500 | 502–521 |
| 397 | 327–346 | 348–366* |
| 398 | 483–502 | 504–523 |
| 399 | 221–239* | 241–260 |
| 400 | 481–500 | 502–521 |
| 401 | 365–383* | 385–404 |
| 402 | 483–502 | 504–523 |
| 403 | 483–502 | 502–521 |
| 404 | 483–502 | 502–521 |
| 405 | 483–502 | 502–521 |
| 406 | 483–502* | 502–521 |
| 407 | 479–498 | 500–518* |
| 408 | 483–502* | 502–521 |
| 409 | 483–502* | 502–521 |
| 410 | 479–498 | 500–518* |
| 411 | 481–500 | 502–520* |
| 412 | 483–502 | 504–523 |
| 413 | 483–502 | 504–523 |
| 414 | 483–502 | 504–523 |
| 415 | 483–502 | 504–523 |
| 416 | 483–502 | 504–523 |
| 417 | 483–502 | 504–523 |
| 418 | 481–500 | 502–520* |
| 419 | 481–500 | 502–521 |
| 420 | 479–498 | 500–518* |
| 421 | 479–498 | 500–519 |
| 422 | 497–498 | 490–509 |
| 433 | 481–500 | 502–521 |
| 434 | 481–500 | 502–521 |
| 435 | 481–500 | 502–521 |
| 436 | 481–500 | — |
| 437 | — | 502–520* |
| 438 | 481–500 | — |
| 439 | 481–500 | — |
| 440 | 481–500 | — |
| 441 | 481–500 | — |
| 442 | 481–500 | — |
| 443 | 481–500 | — |
| 444 | 482–500 | — |
| 445 | 481–500 | — |
| 446 | 481–500 | — |
| 447 | 481–500 | — |
| 448 | 481–500 | — |
| 449 | 481–500 | — |
| 450 | 481–500 | — |
| 451 | 481–500 | — |
| 452 | 481–500 | — |
| 453 | 481–500 | — |
| 454 | 481–500 | — |
| 455 | 481–500 | — |
| 456 | 481–500 | — |
| 457 | 481–500 | — |

TABLE 16-continued

| SEQ ID NO. | POSITION RANGE OF MICROSEQUENCING PRIMERS | COMPLEMENTARY POSITION RANGE OF MICROSEQUENCING PRIMERS |
|---|---|---|
| 458 | 481–500 | — |
| 459 | 481–500 | — |
| 460 | 481–500 | — |
| 461 | 481–500 | — |
| 462 | 481–500 | — |
| 463 | 481–560 | — |
| 465 | 409–428 | — |
| 466 | 481–500 | — |
| 467 | 286–305 | — |
| 468 | 481–500 | — |
| 469 | 481–500 | 502–521 |
| 470 | 481–500 | 502–521 |
| 471 | 481–500 | 502–521 |
| 472 | 481–500 | 502–521 |
| 473 | 192–211 | 213–232 |
| 474 | 481–500 | 502–521 |
| 475 | 481–500 | 502–521 |
| 476 | 481–500 | 502–521 |
| 477 | 481–500 | 502–521 |
| 478 | 481–500 | 502–521 |
| 479 | 245–264 | 266–285 |
| 480 | 481–500 | 502–521 |
| 481 | 481–500 | 502–521 |
| 482 | 481–500 | 502–521 |
| 483 | 481–500 | 502–521 |
| 484 | 481–500 | 502–521 |

TABLE 17

| SEQ. ID NO. | POSITION RANGE OF AMPLIFICATION PRIMERS | COMPLEMENTARY POSITION RANGE OF AMPLIFICATION PRIMERS |
|---|---|---|
| 1 | 362–380 | 792–812 |
| 2 | 310–327 | 751–771 |
| 3 | 304–321 | 745–765 |
| 4 | 82–99 | 540–557 |
| 5 | 308–325 | 830–847 |
| 6 | 304–321 | 803–823 |
| 7 | 131–150 | 561–580 |
| 8 | 287–304 | 805–825 |
| 9 | 284–303 | 716–734 |
| 10 | 394–413 | 826–844 |
| 11 | 270–289 | 704–721 |
| 12 | 444–462 | 874–893 |
| 13 | 73–91 | 577–596 |
| 14 | 139–158 | 634–652 |
| 15 | 372–392 | 808–826 |
| 16 | 429–449 | 865–883 |
| 17 | 233–252 | 693–712 |
| 18 | 122–141 | 582–601 |
| 19 | 298–317 | 772–792 |
| 20 | 296–315 | 770–790 |
| 21 | 200–217 | 679–696 |
| 22 | 442–459 | 921–938 |
| 23 | 228–245 | 760–777 |
| 24 | 378–396 | 911–928 |
| 25 | 203–221 | 736–753 |
| 26 | 37–55 | 570–587 |
| 27 | 222–241 | 655–675 |
| 28 | 436–455 | 880–900 |
| 29 | 476–493 | 945–962 |
| 30 | 266–283 | 735–752 |
| 31 | 278–295 | 613–632 |
| 32 | 418–436 | 823–842 |
| 33 | 216–235 | 646–665 |
| 34 | 91–109 | 510–528 |
| 35 | 137–153 | 586–604 |
| 36 | 137–153 | 586–604 |
| 37 | 206–225 | 727–746 |
| 38 | 400–419 | 856–876 |

TABLE 17-continued

| SEQ. ID NO. | POSITION RANGE OF AMPLIFICATION PRIMERS | COMPLEMENTARY POSITION RANGE OF AMPLIFICATION PRIMERS |
|---|---|---|
| 40 | 146–165 | 588–607 |
| 41 | 62–81 | 504–523 |
| 42 | 210–230 | 591–610 |
| 43 | 307–326 | 797–817 |
| 44 | 277–296 | 767–787 |
| 45 | 1–20 | 402–421 |
| 46 | 3–21 | 404–422 |
| 47 | 1–18 | 355–372 |
| 48 | 1–18 | 356–375 |
| 49 | 108–125 | 539–556 |
| 50 | 259–276 | 592–609 |
| 51 | 229–246 | 630–649 |
| 52 | 325–342 | 659–676 |
| 53 | 357–377 | 795–815 |
| 54 | 186–205 | 621–641 |
| 56 | 1–18 | 416–435 |
| 57 | 1–18 | 416–435 |
| 58 | 1–18 | 416–435 |
| 59 | 185–203 | 593–610 |
| 60 | 1–18 | 424–442 |
| 61 | 1–18 | 424–442 |
| 62 | 1–19 | 401–420 |
| 63 | 1–18 | 412–431 |
| 64 | 1–18 | 412–431 |
| 65 | 1–18 | 412–431 |
| 66 | 1–18 | 412–431 |
| 67 | 1–19 | 403–422 |
| 68 | 1–19 | 403–422 |
| 69 | 1–19 | 336–353 |
| 70 | 1–18 | 406–425 |
| 71 | 1–18 | 406–425 |
| 72 | 1–18 | 406–425 |
| 73 | 1–18 | 406–425 |
| 74 | 1–18 | 405–424 |
| 75 | 1–18 | 405–424 |
| 76 | 1–18 | 405–424 |
| 77 | 1–18 | 334–352 |
| 78 | 228–247 | 660–678 |
| 79 | 298–318 | 806–826 |
| 80 | 132–152 | 586–603 |
| 81 | 132–152 | 586–603 |
| 82 | 308–328 | 779–798 |
| 83 | 122–141 | 598–618 |
| 84 | 390–409 | 768–788 |
| 85 | 323–339 | 800–819 |
| 86 | 411–427 | 761–777 |
| 87 | 212–230 | 590–608 |
| 88 | 154–174 | 746–763 |
| 89 | 124–143 | 647–664 |
| 90 | 1–18 | 417–437 |
| 91 | 1–18 | 417–437 |
| 92 | 1–18 | 406–426 |
| 93 | 3–24 | 405–429 |
| 94 | 3–24 | 405–429 |
| 95 | 1–25 | 400–420 |
| 96 | 1–25 | 400–420 |
| 97 | 1–25 | 400–420 |
| 98 | 1–18 | 405–427 |
| 99 | 1–21 | 396–420 |
| 100 | 1–21 | 396–420 |
| 101 | 1–18 | 423–443 |
| 102 | 1–18 | 423–443 |
| 103 | 1–18 | 429–446 |
| 104 | 1–18 | 429–446 |
| 105 | 1–18 | 429–446 |
| 106 | 1–25 | 399–420 |
| 107 | 1–23 | 398–418 |
| 108 | 1–23 | 398–418 |
| 109 | 1–18 | 427–445 |
| 110 | 1–18 | 427–445 |
| 111 | 1–18 | 416–436 |
| 112 | 1–18 | 416–436 |
| 113 | 1–25 | 396–420 |
| 114 | 1–25 | 396–420 |
| 115 | 1–25 | 396–420 |

TABLE 17-continued

| SEQ. ID NO. | POSITION RANGE OF AMPLIFICATION PRIMERS | COMPLEMENTARY POSITION RANGE OF AMPLIFICATION PRIMERS |
|---|---|---|
| 116 | 1–18 | 416–434 |
| 117 | 1–21 | 396–420 |
| 118 | 1–19 | 405–429 |
| 119 | 1–19 | 405–429 |
| 120 | 1–21 | 422–439 |
| 121 | 1–21 | 422–439 |
| 122 | 1–21 | 422–439 |
| 123 | 1–21 | 422–439 |
| 124 | 1–21 | 422–439 |
| 125 | 1–21 | 413–432 |
| 126 | 1–18 | 404–423 |
| 127 | 1–21 | 411–435 |
| 128 | 1–21 | 411–435 |
| 129 | 1–18 | 428–449 |
| 130 | 1–18 | 395–419 |
| 131 | 3–23 | 398–420 |
| 132 | 1–21 | 418–442 |
| 133 | 1–21 | 418–442 |
| 134 | 1–21 | 418–442 |
| 135 | 1–21 | 418–442 |
| 136 | 1–24 | 404–426 |
| 137 | 1–24 | 404–426 |
| 138 | 1–24 | 404–426 |
| 139 | 1–24 | 404–426 |
| 140 | 1–20 | 396–420 |
| 141 | 459–476 | 859–878 |
| 142 | 126–143 | 526–545 |
| 143 | 451–468 | 853–872 |
| 144 | 388–407 | 758–775 |
| 145 | 226–245 | 705–725 |
| 146 | 220–238 | 636–655 |
| 147 | 478–496 | 820–837 |
| 148 | 95–112 | 504–521 |
| 149 | 297–317 | 742–759 |
| 150 | 416–435 | 868–886 |
| 151 | 139–157 | 579–599 |
| 152 | 139–157 | 579–599 |
| 153 | 122–140 | 562–582 |
| 154 | 472–491 | 926–945 |
| 155 | 449–468 | 982–999 |
| 156 | 86–105 | 615–633 |
| 157 | 285–305 | 751–770 |
| 158 | 290–310 | 756–775 |
| 159 | 184–202 | 616–634 |
| 160 | 113–131 | 545–563 |
| 161 | 85–102 | 534–552 |
| 162 | 313–331 | 792–812 |
| 163 | 252–272 | 681–701 |
| 164 | 252–272 | 681–701 |
| 165 | 252–272 | 681–701 |
| 166 | 252–272 | 681–701 |
| 167 | 403–422 | 927–947 |
| 168 | 81–101 | 513–532 |
| 169 | 154–173 | 685–705 |
| 170 | 53–70 | 558–578 |
| 171 | 248–267 | 684–704 |
| 172 | 447–464 | 849–867 |
| 173 | 394–411 | 796–814 |
| 174 | 235–252 | 637–655 |
| 175 | 478–495 | 889–908 |
| 176 | 113–132 | 518–537 |
| 177 | 400–417 | 800–819 |
| 178 | 430–447 | 830–849 |
| 179 | 182–199 | 582–601 |
| 180 | 142–159 | 542–561 |
| 181 | 415–434 | 821–840 |
| 182 | 442–460 | 870–889 |
| 183 | 439–458 | 946–966 |
| 184 | 113–132 | 620–640 |
| 185 | 10–29 | 517–537 |
| 186 | 370–387 | 812–832 |
| 187 | 257–274 | 699–719 |
| 188 | 68–86 | 533–553 |
| 189 | 192–210 | 740–758 |
| 190 | 20–38 | 568–586 |
| 191 | 108–126 | 566–585 |
| 192 | 453–471 | 911–930 |
| 193 | 62–82 | 580–600 |
| 194 | 294–314 | 812–832 |
| 195 | 295–315 | 813–833 |
| 196 | 6–26 | 524–544 |
| 197 | 234–254 | 704–723 |
| 198 | 331–351 | 801–820 |
| 199 | 213–230 | 678–698 |
| 200 | 223–243 | 720–737 |
| 201 | 271–291 | 768–785 |
| 202 | 468–488 | 965–982 |
| 203 | 311–331 | 802–820 |
| 204 | 86–106 | 528–546 |
| 205 | 189–209 | 621–641 |
| 206 | 266–286 | 777–795 |
| 207 | 90–109 | 514–534 |
| 208 | 127–144 | 571–591 |
| 209 | 336–355 | 784–802 |
| 210 | 230–249 | 678–696 |
| 211 | 78–97 | 526–544 |
| 212 | 283–303 | 711–731 |
| 213 | 168–188 | 636–655 |
| 214 | 80–100 | 535–552 |
| 215 | 90–110 | 545–562 |
| 216 | 446–463 | 993–1013 |
| 217 | 406–423 | 953–973 |
| 218 | 75–92 | 622–642 |
| 219 | 422–441 | 982–1001 |
| 220 | 410–429 | 970–990 |
| 221 | 341–360 | 901–921 |
| 222 | 324–343 | 884–904 |
| 223 | 473–491 | 907–925 |
| 224 | 460–479 | 889–909 |
| 225 | 376–395 | 805–825 |
| 226 | 107–127 | 539–559 |
| 227 | 125–145 | 558–575 |
| 228 | 191–208 | 596–613 |
| 229 | 382–400 | 805–824 |
| 230 | 326–345 | 728–747 |
| 231 | 148–167 | 550–569 |
| 232 | 240–257 | 658–675 |
| 233 | 276–293 | 692–711 |
| 234 | 136–155 | 581–598 |
| 235 | 424–444 | 855–875 |
| 236 | 348–368 | 784–803 |
| 237 | 105–125 | 541–560 |
| 238 | 437–456 | 839–859 |
| 239 | 436–455 | 838–858 |
| 246 | 384–402 | 832–849 |
| 241 | 75–94 | 544–563 |
| 242 | 76–95 | 545–564 |
| 243 | 280–299 | 749–768 |
| 244 | 346–365 | 815–834 |
| 245 | 364–383 | 833–852 |
| 246 | 363–381 | 878–893 |
| 247 | 171–189 | 686–707 |
| 248 | 159–177 | 674–695 |
| 249 | 17–35 | 532–553 |
| 250 | 369–386 | 777–794 |
| 251 | 237–253 | 567–586 |
| 252 | 221–238 | 624–641 |
| 253 | 390–410 | 844–861 |
| 254 | 454–474 | 883–901 |
| 255 | 411–431 | 840–858 |
| 256 | 345–365 | 774–792 |
| 257 | 354–372 | 784–804 |
| 258 | 9–29 | 439–458 |
| 259 | 9–29 | 439–458 |
| 260 | 9–29 | 439–458 |
| 261 | 173–192 | 645–665 |
| 262 | 1–18 | 367–384 |
| 263 | 1–18 | 406–425 |
| 264 | 1–18 | 406–425 |
| 265 | 88–107 | 552–572 |

TABLE 17-continued

| SEQ. ID NO. | POSITION RANGE OF AMPLIFICATION PRIMERS | COMPLEMENTARY POSITION RANGE OF AMPLIFICATION PRIMERS |
|---|---|---|
| 266 | 478–498 | 857–877 |
| 267 | 60–77 | 585–603 |
| 268 | 190–210 | 636–654 |
| 269 | 384–402 | 830–849 |
| 270 | 138–158 | 658–675 |
| 271 | 378–397 | 805–825 |
| 272 | 307–325 | 704–724 |
| 273 | 153–171 | 550–570 |
| 274 | 240–260 | 668–688 |
| 275 | 429–446 | 858–878 |
| 276 | 81–98 | 510–530 |
| 277 | 302–322 | 791–811 |
| 278 | 109–129 | 598–618 |
| 279 | 74–94 | 583–602 |
| 280 | 423–443 | 876–896 |
| 281 | 291–311 | 671–690 |
| 282 | 284–304 | 712–732 |
| 283 | 365–385 | 866–884 |
| 284 | 169–189 | 605–625 |
| 285 | 135–155 | 596–615 |
| 286 | 450–469 | 894–914 |
| 287 | 427–446 | 871–891 |
| 288 | 383–402 | 888–908 |
| 289 | 126–146 | 558–577 |
| 290 | 324–341 | 662–681 |
| 291 | 301–320 | 701–720 |
| 292 | 190–208 | 593–611 |
| 293 | 448–465 | 848–867 |
| 294 | 146–165 | 546–565 |
| 295 | 354–372 | 779–798 |
| 296 | 253–271 | 678–697 |
| 297 | 228–245 | 645–664 |
| 298 | 222–239 | 639–658 |
| 299 | 165–182 | 582–601 |
| 300 | 178–196 | 637–656 |
| 301 | 162–180 | 595–612 |
| 302 | 122–140 | 555–572 |
| 303 | 334–352 | 830–848 |
| 304 | 309–327 | 805–823 |
| 305 | 203–221 | 699–717 |
| 306 | 444–462 | 940–958 |
| 307 | 267–286 | 703–722 |
| 308 | 342–361 | 778–797 |
| 309 | 276–295 | 706–725 |
| 310 | 326–344 | 779–797 |
| 311 | 301–319 | 733–753 |
| 312 | 244–262 | 676–696 |
| 313 | 104–124 | 594–612 |
| 314 | 99–117 | 557–577 |
| 315 | 68–86 | 526–546 |
| 316 | 250–270 | 800–818 |
| 317 | 250–270 | 800–818 |
| 318 | 12–32 | 442–461 |
| 319 | 186–204 | 623–641 |
| 320 | 87–105 | 524–542 |
| 321 | 112–130 | 549–567 |
| 322 | 122–139 | 602–620 |
| 323 | 368–386 | 868–888 |
| 324 | 173–191 | 673–693 |
| 325 | 117–135 | 617–637 |
| 326 | 181–200 | 640–658 |
| 327 | 414–433 | 873–891 |
| 328 | 187–205 | 637–657 |
| 329 | 181–199 | 631–651 |
| 330 | 50–68 | 533–552 |
| 331 | 148–167 | 651–669 |
| 332 | 12–31 | 515–533 |
| 333 | 271–291 | 655–674 |
| 334 | 144–164 | 528–547 |
| 335 | 375–395 | 765–783 |
| 336 | 403–423 | 793–811 |
| 337 | 368–387 | 800–820 |
| 338 | 328–345 | 827–845 |
| 339 | 306–323 | 805–823 |
| 346 | 232–249 | 731–749 |
| 341 | 50–68 | 553–572 |
| 342 | 386–405 | 867–887 |
| 343 | 23–43 | 522–540 |
| 344 | 99–116 | 628–647 |
| 345 | 412–429 | 844–862 |
| 346 | 67–87 | 513–533 |
| 347 | 230–247 | 691–710 |
| 348 | 446–463 | 907–926 |
| 349 | 345–363 | 729–749 |
| 350 | 478–497 | 909–927 |
| 351 | 479–498 | 880–899 |
| 352 | 420–439 | 788–807 |
| 353 | 420–439 | 788–807 |
| 355 | 171–189 | 582–600 |
| 356 | 220–238 | 624–641 |
| 357 | 230–250 | 698–717 |
| 358 | 144–164 | 573–593 |
| 359 | 290–310 | 719–739 |
| 360 | 156–176 | 629–649 |
| 361 | 296–316 | 769–789 |
| 362 | 324–344 | 797–817 |
| 363 | 412–432 | 885–905 |
| 364 | 127–147 | 600–618 |
| 365 | 129–149 | 602–620 |
| 366 | 163–183 | 636–654 |
| 367 | 163–183 | 636–654 |
| 368 | 117–135 | 592–612 |
| 369 | 87–105 | 562–582 |
| 370 | 6–26 | 474–494 |
| 371 | 6–26 | 474–494 |
| 372 | 359–378 | 788–808 |
| 373 | 129–147 | 607–627 |
| 374 | 129–147 | 607–627 |
| 375 | 100–118 | 578–598 |
| 376 | 184–203 | 615–635 |
| 377 | 184–203 | 615–635 |
| 378 | 184–203 | 615–635 |
| 379 | 131–150 | 562–582 |
| 380 | 390–410 | 903–921 |
| 381 | 76–96 | 595–613 |
| 382 | 168–188 | 687–705 |
| 383 | 108–128 | 566–586 |
| 384 | 384–404 | 863–883 |
| 385 | 120–139 | 552–572 |
| 386 | 173–193 | 692–712 |
| 387 | 418–435 | 979–1000 |
| 388 | 353–372 | 809–829 |
| 389 | 348–367 | 804–824 |
| 390 | 251–270 | 707–727 |
| 391 | 52–71 | 508–528 |
| 392 | 46–65 | 533–553 |
| 393 | 20–39 | 507–527 |
| 394 | 18–38 | 505–525 |
| 395 | 18–38 | 505–525 |
| 396 | 18–38 | 505–525 |
| 397 | 272–292 | 704–724 |
| 398 | 209–229 | 641–661 |
| 399 | 219–237 | 653–673 |
| 400 | 437–457 | 908–928 |
| 401 | 279–298 | 773–793 |
| 402 | 252–271 | 746–766 |
| 403 | 238–257 | 660–679 |
| 404 | 172–189 | 578–597 |
| 405 | 135–152 | 545–564 |
| 406 | 346–366 | 801–821 |
| 407 | 386–406 | 847–865 |
| 408 | 335–355 | 787–807 |
| 409 | 237–257 | 680–700 |
| 410 | 121–140 | 565–584 |
| 411 | 339–357 | 781–801 |
| 412 | 220–238 | 621–639 |
| 413 | 283–301 | 686–704 |
| 414 | 272–290 | 675–693 |
| 415 | 269–287 | 672–690 |
| 416 | 268–286 | 671–689 |

TABLE 17-continued

| SEQ. ID NO. | POSITION RANGE OF AMPLIFICATION PRIMERS | COMPLEMENTARY POSITION RANGE OF AMPLIFICATION PRIMERS |
|---|---|---|
| 417 | 219–237 | 622–640 |
| 418 | 444–464 | 901–921 |
| 419 | 179–199 | 689–707 |
| 420 | 114–134 | 597–615 |
| 421 | 175–195 | 658–676 |
| 422 | 228–248 | 711–729 |
| 423 | 251–271 | 776–795 |
| 424 | 461–481 | 981–1001 |
| 425 | 343–363 | 781–799 |
| 426 | 424–442 | 952–971 |
| 427 | 309–326 | 777–797 |
| 428 | 455–473 | 907–927 |
| 429 | 40–59 | 551–569 |
| 430 | 114–134 | 562–582 |
| 431 | 115–135 | 563–583 |
| 432 | 127–147 | 575–595 |
| 433 | 179–199 | 627–647 |
| 434 | 321–341 | 769–789 |
| 435 | 326–346 | 774–794 |
| 436 | 367–385 | 797–817 |
| 437 | 184–203 | 616–633 |
| 438 | 86–106 | 546–563 |
| 439 | 260–279 | 755–773 |
| 446 | 255–272 | 773–790 |
| 441 | 303–322 | 736–756 |
| 442 | 215–233 | 617–635 |
| 443 | 479–499 | 913–932 |
| 444 | 204–222 | 634–654 |
| 445 | 104–121 | 506–525 |
| 446 | 370–387 | 769–793 |
| 447 | 475–495 | 870–892 |
| 448 | 347–367 | 764–788 |
| 449 | 111–132 | 513–537 |
| 450 | 96–113 | 601–621 |
| 451 | 149–167 | 577–596 |
| 452 | 312–329 | 713–731 |
| 453 | 128–145 | 530–548 |
| 454 | 444–461 | 855–874 |
| 455 | 76–95 | 583–603 |
| 456 | 333–353 | 774–793 |
| 457 | 136–156 | 567–586 |
| 458 | 286–306 | 714–73 |
| 459 | 152–172 | 585–602 |
| 460 | 59–78 | 523–543 |
| 461 | 251–271 | 771–788 |
| 462 | 119–136 | 679–696 |
| 463 | 170–188 | 574–591 |
| 465 | 179–198 | 611–631 |
| 466 | 83–103 | 554–574 |
| 467 | 279–298 | 773–793 |
| 468 | 340–360 | 788–808 |
| 469 | 177–196 | 576–595 |
| 470 | 465–484 | 864–883 |
| 471 | 270–288 | 527–545 |
| 472 | 325–345 | 783–800 |
| 473 | 1–20 | 413–432 |
| 474 | 213–231 | 613–631 |
| 475 | 158–176 | 558–576 |
| 476 | 128–146 | 528–546 |
| 477 | 307–324 | 700–719 |
| 478 | 474–491 | 890–909 |
| 479 | 1–19 | 404–422 |
| 480 | 387–407 | 833–853 |
| 481 | 454–472 | 919–939 |
| 482 | 113–133 | 631–651 |
| 483 | 288–305 | 753–773 |
| 484 | 174–193 | 573–592 |

TABLE 18

| SEQ ID NO. | POSITION RANGE OF PROBES |
|---|---|
| 1 | 489–513 |
| 2 | 489–513 |
| 3 | 489–513 |
| 4 | 489–513 |
| 5 | 449–473 |
| 6 | 489–513 |
| 7 | 489–513 |
| 8 | 489–513 |
| 9 | 489–513 |
| 10 | 489–513 |
| 11 | 489–513 |
| 12 | 489–513 |
| 13 | 489–513 |
| 14 | 489–513 |
| 15 | 489–513 |
| 16 | 489–513 |
| 17 | 489–513 |
| 18 | 489–513 |
| 19 | 489–513 |
| 20 | 489–513 |
| 21 | 489–513 |
| 22 | 489–513 |
| 23 | 489–513 |
| 24 | 489–513 |
| 25 | 489–513 |
| 26 | 489–513 |
| 27 | 489–513 |
| 28 | 489–513 |
| 29 | 489–513 |
| 30 | 489–513 |
| 31 | 489–513 |
| 32 | 489–513 |
| 33 | 489–513 |
| 34 | 489–513 |
| 35 | 220–244 |
| 36 | 274–298 |
| 37 | 488–512 |
| 38 | 468–492 |
| 40 | 414–438 |
| 41 | 489–513 |
| 42 | 491–515 |
| 43 | 489–513 |
| 44 | 489–513 |
| 45 | 318–342 |
| 46 | 330–354 |
| 47 | 265–289 |
| 48 | 285–309 |
| 49 | 489–513 |
| 50 | 489–513 |
| 51 | 489–513 |
| 52 | 489–513 |
| 53 | 489–513 |
| 54 | 489–513 |
| 56 | 166–190 |
| 57 | 206–230 |
| 58 | 322–346 |
| 59 | 489–513 |
| 60 | 66–90 |
| 61 | 92–116 |
| 62 | 40–64 |
| 66 | 234–258 |
| 69 | 157–181 |
| 70 | 140–164 |
| 71 | 231–255 |
| 72 | 265–289 |
| 73 | 283–307 |
| 74 | 31–55 |
| 75 | 105–129 |
| 76 | 308–332 |
| 77 | 109–133 |
| 78 | 489–513 |
| 79 | 438–462 |
| 80 | 234–258 |
| 81 | 299–323 |
| 82 | 487–511 |
| 83 | 7489–513 |
| 84 | 489–513 |

TABLE 18-continued

| SEQ ID NO. | POSITION RANGE OF PROBES |
|---|---|
| 85 | 491–515 |
| 86 | 489–513 |
| 87 | 491–515 |
| 88 | 489–513 |
| 89 | 489–513 |
| 90 | 204–228 |
| 91 | 385–409 |
| 92 | 220–244 |
| 93 | 39–63 |
| 94 | 114–138 |
| 95 | 190–214 |
| 96 | 263–287 |
| 97 | 334–358 |
| 98 | 159–183 |
| 99 | 176–200 |
| 100 | 211–235 |
| 101 | 95–119 |
| 102 | 365–389 |
| 103 | 272–296 |
| 104 | 144–168 |
| 105 | 367–391 |
| 106 | 211–235 |
| 107 | 227–251 |
| 108 | 358–382 |
| 109 | 92–116 |
| 110 | 383–407 |
| 111 | 31–55 |
| 112 | 126–150 |
| 113 | 70–94 |
| 114 | 154–178 |
| 115 | 232–256 |
| 116 | 103–127 |
| 117 | 24–48 |
| 118 | 173–197 |
| 119 | 366–390 |
| 120 | 130–154 |
| 121 | 15–78 |
| 122 | 192–216 |
| 123 | 193–277 |
| 124 | 301–325 |
| 125 | 56–80 |
| 126 | 345–369 |
| 127 | 244–268 |
| 128 | 341–365 |
| 129 | 224–248 |
| 130 | 127–151 |
| 131 | 201–225 |
| 132 | 26–50 |
| 133 | 171–195 |
| 134 | 323–347 |
| 135 | 382–406 |
| 136 | 27–51 |
| 137 | 60–84 |
| 138 | 144–168 |
| 139 | 273–297 |
| 140 | 155–179 |
| 141 | 489–513 |
| 142 | 489–513 |
| 143 | 489–513 |
| 144 | 465–489 |
| 145 | 421–445 |
| 146 | 489–513 |
| 147 | 491–515 |
| 148 | 489–513 |
| 149 | 489–513 |
| 150 | 489–513 |
| 151 | 345–369 |
| 152 | 461–485 |
| 153 | 489–513 |
| 154 | 489–513 |
| 155 | 467–491 |
| 156 | 488–512 |
| 157 | 489–513 |
| 158 | 489–513 |
| 159 | 491–515 |
| 160 | 491–515 |
| 161 | 489–513 |
| 162 | 489–513 |
| 163 | 369–393 |
| 164 | 449–473 |
| 165 | 461–485 |
| 166 | 479–503 |
| 167 | 489–513 |
| 168 | 489–513 |
| 169 | 489–513 |
| 170 | 489–513 |
| 171 | 489–513 |
| 172 | 489–513 |
| 173 | 489–513 |
| 174 | 489–513 |
| 175 | 485–509 |
| 176 | 489–513 |
| 177 | 489–513 |
| 178 | 489–513 |
| 179 | 489–513 |
| 180 | 489–513 |
| 181 | 489–513 |
| 182 | 489–513 |
| 183 | 489–513 |
| 184 | 489–513 |
| 185 | 489–513 |
| 186 | 489–513 |
| 187 | 489–513 |
| 188 | 489–513 |
| 189 | 489–513 |
| 190 | 489–513 |
| 191 | 489–513 |
| 192 | 473–497 |
| 193 | 489–513 |
| 194 | 489–513 |
| 195 | 489–513 |
| 196 | 489–513 |
| 197 | 489–513 |
| 198 | 489–513 |
| 199 | 489–513 |
| 200 | 489–513 |
| 201 | 489–513 |
| 203 | 487–511 |
| 204 | 489–513 |
| 205 | 489–513 |
| 206 | 489–513 |
| 207 | 489–513 |
| 208 | 459–513 |
| 209 | 489–513 |
| 210 | 489–513 |
| 211 | 489–513 |
| 212 | 489–513 |
| 213 | 489–513 |
| 214 | 489–513 |
| 215 | 489–513 |
| 216 | 487–511 |
| 217 | 489–513 |
| 218 | 489–513 |
| 219 | 462–486 |
| 220 | 489–513 |
| 221 | 488–512 |
| 222 | 489–513 |
| 223 | 489–513 |
| 274 | 489–513 |
| 225 | 489–513 |
| 226 | 489–513 |
| 227 | 489–513 |
| 228 | 489–513 |
| 229 | 489–513 |
| 230 | 489–513 |
| 231 | 489–513 |
| 232 | 489–513 |
| 233 | 489–513 |
| 234 | 489–513 |
| 235 | 489–513 |
| 236 | 489–513 |
| 237 | 489–513 |
| 238 | 489–513 |
| 239 | 489–513 |

TABLE 18-continued

| SEQ ID NO. | POSITION RANGE OF PROBES |
|---|---|
| 240 | 489–513 |
| 241 | 489–513 |
| 242 | 490–514 |
| 243 | 489–513 |
| 244 | 489–513 |
| 245 | 489–513 |
| 246 | 489–513 |
| 247 | 489–513 |
| 248 | 489–513 |
| 249 | 489–513 |
| 250 | 489–513 |
| 251 | 472–496 |
| 252 | 489–513 |
| 253 | 489–513 |
| 254 | 489–513 |
| 255 | 489–513 |
| 256 | 489–513 |
| 257 | 489–513 |
| 258 | 241–265 |
| 259 | 367–391 |
| 260 | 422–446 |
| 261 | 491–515 |
| 262 | 142–166 |
| 263 | 193–217 |
| 264 | 339–363 |
| 265 | 489–513 |
| 266 | 487–511 |
| 267 | 489–513 |
| 268 | 489–513 |
| 269 | 489–513 |
| 270 | 489–513 |
| 271 | 489–513 |
| 272 | 489–513 |
| 273 | 489–513 |
| 274 | 489–513 |
| 275 | 489–513 |
| 276 | 489–513 |
| 277 | 489–513 |
| 278 | 489–513 |
| 279 | 489–513 |
| 280 | 489–513 |
| 281 | 489–513 |
| 282 | 469–513 |
| 283 | 493–517 |
| 284 | 489–513 |
| 285 | 489–513 |
| 286 | 489–513 |
| 287 | 489–513 |
| 288 | 489–513 |
| 289 | 489–513 |
| 290 | 489–513 |
| 291 | 491–515 |
| 292 | 489–513 |
| 293 | 489–513 |
| 294 | 489–513 |
| 295 | 489–513 |
| 296 | 489–513 |
| 297 | 489–513 |
| 298 | 489–513 |
| 299 | 489–513 |
| 300 | 489–513 |
| 301 | 489–513 |
| 302 | 489–513 |
| 303 | 489–513 |
| 304 | 489–513 |
| 305 | 489–513 |
| 306 | 489–513 |
| 307 | 489–513 |
| 308 | 489–513 |
| 309 | 489–513 |
| 310 | 489–513 |
| 311 | 489–513 |
| 312 | 489–513 |
| 313 | 489–513 |
| 314 | 243–267 |
| 315 | 489–513 |
| 316 | 654–678 |
| 317 | 489–513 |
| 318 | 237–261 |
| 319 | 489–513 |
| 320 | 489–513 |
| 321 | 489–513 |
| 322 | 489–513 |
| 323 | 489–513 |
| 324 | 489–513 |
| 325 | 489–513 |
| 326 | 489–513 |
| 327 | 489–513 |
| 328 | 489–513 |
| 329 | 489–513 |
| 330 | 489–513 |
| 331 | 489–513 |
| 332 | 489–513 |
| 333 | 489–513 |
| 334 | 489–513 |
| 335 | 489–513 |
| 336 | 489–513 |
| 337 | 489–513 |
| 338 | 489–513 |
| 339 | 489–513 |
| 340 | 489–513 |
| 341 | 489–513 |
| 342 | 489–513 |
| 343 | 489–513 |
| 344 | 489–513 |
| 345 | 489–513 |
| 346 | 489–513 |
| 347 | 489–513 |
| 348 | 468–492 |
| 349 | 489–513 |
| 350 | 486–510 |
| 351 | 491–515 |
| 352 | 491–515 |
| 353 | 491–515 |
| 355 | 491–515 |
| 356 | 491–515 |
| 357 | 487–511 |
| 358 | 487–511 |
| 359 | 487–511 |
| 360 | 487–511 |
| 361 | 487–511 |
| 362 | 487–511 |
| 363 | 487–511 |
| 364 | 487–511 |
| 365 | 487–511 |
| 366 | 420–444 |
| 367 | 376–400 |
| 368 | 491–515 |
| 369 | 491–515 |
| 370 | 422–446 |
| 371 | 426–450 |
| 372 | 491–515 |
| 373 | 239–263 |
| 374 | 416–440 |
| 375 | 489–513 |
| 376 | 286–310 |
| 377 | 374–398 |
| 378 | 445–469 |
| 379 | 489–513 |
| 380 | 487–511 |
| 381 | 487–511 |
| 382 | 487–511 |
| 383 | 491–515 |
| 384 | 491–515 |
| 385 | 489–513 |
| 386 | 489–318 |
| 387 | 485–509 |
| 388 | 489–513 |
| 389 | 489–513 |
| 390 | 489–513 |
| 391 | 489–513 |
| 392 | 232–256 |
| 393 | 489–513 |
| 394 | 41–65 |

TABLE 18-continued

| SEQ ID NO. | POSITION RANGE OF PROBES |
|---|---|
| 395 | 181–205 |
| 396 | 489–513 |
| 397 | 335–359 |
| 398 | 491–515 |
| 399 | 228–252 |
| 400 | 489–513 |
| 401 | 372–396 |
| 402 | 491–515 |
| 403 | 491–515 |
| 404 | 491–515 |
| 405 | 491–515 |
| 406 | 491–515 |
| 407 | 487–511 |
| 408 | 489–513 |
| 409 | 489–513 |
| 410 | 487–511 |
| 411 | 489–513 |
| 412 | 491–515 |
| 413 | 491–515 |
| 414 | 491–515 |
| 415 | 491–515 |
| 416 | 491–515 |
| 417 | 491–515 |
| 418 | 489–513 |
| 419 | 489–513 |
| 420 | 487–511 |
| 421 | 487–511 |
| 422 | 487–511 |
| 423 | 489–513 |
| 424 | 489–513 |
| 425 | 487–511 |
| 426 | 489–513 |
| 427 | 491–515 |
| 428 | 491–515 |
| 429 | 352–376 |
| 430 | 489–513 |
| 431 | 489–513 |
| 432 | 477–501 |
| 433 | 489–513 |
| 434 | 489–513 |
| 435 | 489–513 |
| 436 | 489–513 |
| 437 | 489–513 |
| 438 | 489–513 |
| 439 | 489–513 |
| 440 | 489–513 |
| 441 | 489–513 |
| 442 | 489–513 |
| 443 | 489–513 |
| 444 | 489–513 |
| 445 | 489–513 |
| 446 | 489–513 |
| 447 | 489–513 |
| 448 | 489–513 |
| 449 | 489–513 |
| 450 | 489–513 |
| 451 | 489–513 |
| 452 | 489–513 |
| 453 | 489–513 |
| 454 | 489–513 |
| 455 | 489–513 |
| 456 | 489–513 |
| 457 | 489–513 |
| 458 | 489–513 |
| 459 | 489–513 |
| 460 | 489–513 |
| 461 | 489–513 |
| 462 | 489–513 |
| 463 | 489–513 |
| 464 | 489–513 |
| 465 | 417–441 |
| 466 | 489–513 |
| 467 | 294–318 |
| 468 | 489–513 |
| 469 | 489–513 |
| 470 | 489–513 |
| 471 | 489–513 |
| 472 | 489–513 |
| 473 | 200–224 |
| 474 | 489–513 |
| 475 | 489–513 |
| 476 | 489–513 |
| 477 | 489–513 |
| 478 | 489–513 |
| 479 | 253–277 |
| 480 | 489–513 |
| 481 | 489–513 |
| 482 | 489–513 |
| 483 | 489–513 |
| 484 | 489–513 |

TABLE 19

MGST-II ALLELE FREQUENCY DATA (FRENCH and US)

| Seq. ID No. | Protein | Biallelic Marker ID | Caucasian FRENCH | | | | | Caucasian US | | | | |
|---|---|---|---|---|---|---|---|---|---|---|---|---|
| | | | size | A | C | G | T | size | A | C | G | T |
| 1 | MGST-II | 12-421/140 | not genotyped for this population | | | | | 183 | 79.51 | | 20.49 | |
| 3 | MGST-II | 12-424/198 | | | | | | 176 | | | 61.08 | 38.92 |
| 5 | MGST-II | 12-426/154 | | | | | | 181 | 58.01 | | 41.99 | |
| 7 | MGST-II | 12-430/80 | | | | | | 93 | 5.38 | | 94.62 | |
| 9 | MGST-II | 12-441/233 | | | | | | 182 | | 35.44 | | 64.56 |
| 12 | MGST-II | 12-447/58 | | | | | | 93 | | 55.38 | 44.62 | |
| 13 | MGST-II | 12-453/429 | | | | | | 183 | | 56.28 | | 43.72 |
| 14 | MGST-II | 12-454/363 | | | | | | 188 | 18.62 | | 81.38 | |
| 15 | MGST-II | 12-455/326 | | | | | | 93 | 58.06 | | 41.94 | |
| 21 | MGST-II | 12-458/196 | | | | | | 180 | 80.83 | | | 19.17 |
| 25 | MGST-II | 12-461/299 | | | | | | 183 | | 40.44 | | 59.56 |
| 436 | MGST-II | 12-421/135 | | | | | | 185 | | | 84.59 | 15.41 |
| 437 | MGST-II | 12-442/133 | | | | | | 94 | | 5.85 | 94.15 | |

TABLE 20

ME1 ALLELE FREQUENCY DATA (US)

| Seq. ID No. | Protein | Biallelic Marker ID | size | A | C | G | T |
|---|---|---|---|---|---|---|---|
| 31 | ME1 | 10-428-219 | 189 | 66.67 | | 33.33 | |
| 33 | ME1 | 10-420-284 | 184 | | 1.36 | | 98.64 |
| 35 | ME1 | 12-713-95 | 190 | | 32.63 | | 67.37 |
| 37 | ME1 | 12-716-295 | 189 | | 66.14 | | 33.86 |
| 38 | ME1 | 12-720-80 | 190 | | 33.95 | 66.05 | |

TABLE 20-continued

ME1 ALLELE FREQUENCY DATA (US)

| Seq. ID No. | Protein | Biallelic Marker ID | size | A | C | G | T |
|---|---|---|---|---|---|---|---|
| 41 | ME1 | 12-721-440 | 94 | 1.6 | | 98.4 | |
| 42 | ME1 | 12-723-293 | 92 | | 99.46 | | 0.54 |
| 44 | ME1 | 12-724-225 | 190 | | 73.16 | | 26.84 |

TABLE 21

Allele Frequency Data (French and US)

| Seq. ID No. | Protein | Biallelic Marker ID | Caucasian FRENCH | | | | | Caucasian US | | | | |
|---|---|---|---|---|---|---|---|---|---|---|---|---|
| | | | size | A | C | G | T | size | A | C | G | T |
| 336 | UGT1A7 | 12-148-311 | 88 | 47.73 | | 52.27 | | 190 | 44.47 | | 55.53 | |
| 345 | UGT1A7 | 12-156-91 | 90 | 50.56 | | 49.44 | | 93 | 50.54 | | 49.46 | |
| 300 | UGT1A7 | 12-121-326 | 93 | 30.11 | | 69.89 | | 188 | 28.99 | | 71.01 | |
| 309 | UGT1A7 | 12-128-225 | 93 | 50.54 | 49.46 | | | 187 | 55.35 | 44.65 | | |
| 304 | UGT1A7 | 12-124-194 | 85 | | 19.41 | | 80.59 | | | | | |
| 326 | UGT1A7 | 12-141-159 | 92 | 37.5 | | 62.5 | | | | | | |
| 330 | UGT1A7 | 12-143-453 | 82 | 50.61 | | 49.39 | | | | | | |
| 322 | UGT1A7 | 12-139-380 | 85 | 17.65 | | 82.35 | | 190 | 20.79 | | 79.21 | |
| 342 | UGT1A7 | 12-153-116 | 90 | | 62.22 | | 37.78 | | | | | |
| 323 | UGT1A7 | 12-140-134 | 89 | | | 58.99 | 41.01 | 183 | | | 56.01 | 43.99 |
| 329 | UGT1A7 | 12-142-321 | 90 | 54.44 | | 45.56 | | | | | | |

TABLE 22

| Protein | Biallelic Marker ID | Caucasian FRENCH | | | | | Caucasian US | | | | |
|---|---|---|---|---|---|---|---|---|---|---|---|
| | | size | A | C | G | T | size | A | C | G | T |
| UGT2B4 | 12-653-423 | 6 | 25 | | | 75 | 177 | 73.45 | | | 26.55 |
| UGT2B4 | 10-470-25 | 179 | 56.15 | | | 43.85 | 90 | 55.56 | | | 44.44 |
| UGT2B4 | 10-494-284 | 6 | | 16.67 | | 83.33 | 185 | | 22.97 | | 77.03 |
| UGT2B4 | 10-471-84 | 178 | 24.44 | | | 75.56 | 92 | 27.17 | | | 72.83 |
| UGT2B4 | 10-471-85 | 0 | | | | | 188 | 26.6 | 73.4 | | |
| UGT2B4 | 12-637-219 | 0 | | | | | 187 | | 33.42 | | 66.58 |
| UGT2B4 | 12-639-95 | 0 | | | | | 187 | | 35.56 | | 64.44 |
| UGT2B4 | 12-652-203 | 4 | 50 | 50 | | | 189 | 57.67 | 42.33 | | |
| UGT2B4 | 12-642-417 | 0 | | | | | 186 | 73.66 | | 26.34 | |
| UGT2B4 | 12-648-300 | 0 | | | | | 91 | | 62.09 | | 37.91 |

TABLE 23

HAPLOTYPE ANALYSIS (MGST-II vs ASTHMA)

297 ALT vs 286 Caucasian US

| MARKERS MGST2 | | 12-421/135 | 12-421/140 | 12-430/80 | 12-441/233 | 12-442/133 | 12-447/58 | 12-455/326 | 12-451/299 | 12-453/429 | 12-454/363 | 12-458/196 | 12-426/154 |
|---|---|---|---|---|---|---|---|---|---|---|---|---|---|
| | | | InB | | | | | markers in bac | | | | | |
| size (cases/controls) | | 282 vs 185 | 281 vs 183 | 163 vs 93 | 285 vs 182 | 172 vs 94 | 287 vs 93 | 167 vs 93 | 287 vs 183 | 267 vs 183 | 260 vs 176 | 277 vs 168 | 277 vs 180 | 273 vs 161 |
| allelic frequency % (case/controls) | | 85/84 (G) | 81/79 (A) | 8/5 (A) | 35/35 (C) | 8/5 (C) | 45/44 (G) | 44/41 (G) | 63/59 (T) | 60/56 (C) | 40/36 (T) | 21/16 (A) | 61/80 (A) | 59/58 (A) |
| diff freq. all. (cases-controls) | | 1.0 | 2.2 | 3.2 | 0.3 | 2.3 | 1.0 | 2.4 | 3.5 | 4.7 | 1.7 | 2.5 | 0.8 | 1.3 |
| pvalue | | 6.6e-01 | 4.0e-01 | 1.8e-01 | 7.5e-01 | 3.2e-01 | 7.5e-01 | 5.8e-01 | 2.7e-01 | 1.5e-01 | 5.8e-01 | 3.4e-01 | 7.5e-01 | 6.6e-01 |
| | | 1.1 | 1.1 | 1.6 | 1.0 | 1.4 | 1.0 | 1.1 | 1.2 | 1.2 | 1.1 | 1.2 | 1.1 | 1.1 |
| Test Hardy Weinberg Equilibrium | cases vs | 0.00 HW | -0.00 HW | -0.00 HW | 0.01 HW | -0.00 HW | -0.00 HW | 0.01 HW | 0.01 HW | -0.02 HW | 0.02 HW | 0.00 HW | 0.01 HW | 0.02 HW |
| | controls | 0.01 HW | 0.00 HW | 0.89 | 0.01 HW | 0.88 | -0.04 HW | 0.02 HW | -0.03 HW | 0.00 HW | -0.02 HW | 0.00 HW | -0.00 HW | 0.00 HW |
| haplotype 1 | PT2 | 286 vs 180 | | | | | | | | | | | | |
| haplotype 2 | | 157 vs 93 | | | | | | | | | | | | |
| haplotype 3 | | 164 vs 94 | | | | | | | | | | | | |
| haplotype 4 | | 276 vs 93 | | | | | | | | | | | | |
| haplotype 5 | | 260 vs 170 | | | | | | | | | | | | |
| haplotype 6 | PT3 | 151 vs 86 | | | | | | | G | T | C | G | | |
| haplotype 7 | | 247 vs 162 | | | | | C | | | | C | | | |
| haplotype 8 | | 166 vs 92 | | | | | | | G | C | C | G | | |
| haplotype 9 | | 166 vs 93 | | | | | | | G | C | T | | | |
| haplotype 10 | | 258 vs 165 | | | | | | | | T | | T | | |
| haplotype 11 | | 265 vs 166 | | | | | | | A | T | | T | | |
| haplotype 12 | | 150 vs 86 | | | | | | | | T | C | T | | |
| haplotype 13 | | 281 vs 175 | | | | | | | A | C | C | T | A | |
| haplotype 14 | | 277 vs 170 | | | | | | | | | | T | A | |
| haplotype 15 | | 150 vs 81 | | | A | | G | | | | | | | |
| haplotype 16 | | 284 vs 176 | | A | | | | | | | | | | |
| haplotype 17 | | 271 vs 88 | G | | | | | G | | | | | | |
| haplotype 18 | PT4 | 144 vs 86 | | | | | | | | | C | G | | |
| haplotype 19 | | 166 vs 92 | | | | | | | | A | T | | | |
| haplotype 20 | | 149 vs 85 | | | | | | | G | T | T | T | | |
| haplotype 21 | | 146 vs 79 | | | | | | | A | T | C | G | | |
| haplotype 22 | | 271 vs 88 | | | | | | | G | T | T | G | | |
| haplotype 23 | | 151 vs 86 | | | | | | C | G | T | C | T | | |
| haplotype 24 | | 151 vs 85 | | | | | | | A | T | T | G | | |
| haplotype 25 | | 150 vs 81 | | | | | | | G | C | T | G | | |
| haplotype 26 | | 143 vs 85 | | | | | G | | A | T | C | T | A | |
| haplotype 27 | | 150 vs 86 | | | | | | | G | C | C | G | | G |
| haplotype 28 | | 243 vs 159 | | | | | | | | T | T | T | A | G |
| haplotype 29 | | 240 vs 161 | G | | | | | | G | C | C | T | | G |
| haplotype 30 | | | | | | | | | | | | | | |

TABLE 23-continued

| | | | haplotype frequencies | | ESTIMATED FREQUENCIES | | | | |
|---|---|---|---|---|---|---|---|---|---|
| | | | cases | controls | p-excess | Odds ratio | Chi-S | Pvalue (1 df) | |
| haplotype 1 | PT2 | 286 vs 180 | 0.390 | 0.310 | 11.60 | 1.42 | 6.16 | 1.3e-02 | ** |
| haplotype 2 | | 157 vs 93 | 0.076 | 0.025 | 5.18 | 3.16 | 5.54 | 1.8e-02 | ** |
| haplotype 3 | | 164 vs 94 | 0.073 | 0.025 | 4.93 | 3.10 | 5.28 | 2.1e-02 | ** |
| haplotype 4 | | 276 vs 93 | 0.068 | 0.025 | 4.46 | 2.89 | 4.89 | 2.7e-02 | ** |
| haplotype 5 | | 260 vs 170 | 0.216 | 0.156 | 7.14 | 1.49 | 4.81 | 2.7e-02 | ** |
| haplotype 6 | PT3 | 151 vs 86 | 0.118 | 0.011 | 10.81 | 12.22 | 17.23 | 3.2e-05 | ***** |
| haplotype 7 | | 247 vs 162 | 0.097 | 0.027 | 7.13 | 3.80 | 14.60 | 1.3e-04 | *** |
| haplotype 8 | | 166 vs 92 | 0.112 | 0.027 | 8.69 | 4.53 | 11.33 | 7.3e-04 | *** |
| haplotype 9 | | 166 vs 93 | 0.098 | 0.022 | 7.75 | 4.75 | 10.38 | 1.3e-03 | *** |
| haplotype 10 | | 258 vs 165 | 0.150 | 0.077 | 7.99 | 2.13 | 10.25 | 1.3e-03 | *** |
| haplotype 11 | | 265 vs 166 | 0.251 | 0.171 | 9.68 | 1.63 | 7.66 | 5.5e-03 | ** |
| haplotype 12 | | 150 vs 86 | 0.105 | 0.034 | 7.36 | 3.34 | 7.59 | 5.8e-03 | ** |
| haplotype 13 | | 281 vs 175 | 0.340 | 0.255 | 11.36 | 1.50 | 7.26 | 6.9e-03 | ** |
| haplotype 14 | | 277 vs 170 | 0.322 | 0.238 | 11.02 | 1.52 | 7.20 | 6.9e-03 | ** |
| haplotype 15 | | 150 vs 81 | 0.193 | 0.096 | 10.53 | 2.20 | 7.07 | 7.7e-03 | ** |
| haplotype 16 | | 284 vs 176 | 0.262 | 0.187 | 9.29 | 1.55 | 6.94 | 8.2e-03 | ** |
| haplotype 17 | | 271 vs 88 | 0.088 | 0.028 | 6.12 | 3.29 | 6.91 | 8.2e-03 | ** |
| haplotype 18 | PT4 | 144 vs 86 | 0.126 | 0.000 | 12.60 | 100.00 | 23.52 | 1.2e-08 | ******* |
| haplotype 19 | | 166 vs 92 | 0.101 | 0.000 | 10.09 | 100.00 | 19.85 | 8.2e-06 | ***** |
| haplotype 20 | | 149 vs 85 | 0.131 | 0.010 | 12.20 | 14.29 | 19.79 | 8.6e-06 | ****** |
| haplotype 21 | | 146 vs 79 | 0.131 | 0.009 | 12.32 | 16.46 | 18.98 | 1.3e-05 | ****** |
| haplotype 22 | | 271 vs 88 | 0.099 | 0.000 | 9.89 | 100.00 | 18.81 | 1.4e-05 | ****** |
| haplotype 23 | | 151 vs 86 | 0.123 | 0.011 | 11.29 | 12.37 | 18.08 | 2.1e-05 | ****** |
| haplotype 24 | | 151 vs 85 | 0.092 | 0.000 | 9.22 | 100.00 | 16.66 | 4.4e-05 | ***** |
| haplotype 25 | | 151 vs 86 | 0.130 | 0.019 | 11.26 | 7.72 | 16.48 | 4.9e-05 | ***** |
| haplotype 26 | | 150 vs 81 | 0.119 | 0.011 | 10.91 | 11.94 | 16.40 | 5.1e-05 | ***** |
| haplotype 27 | | 143 vs 85 | 0.131 | 0.019 | 11.37 | 7.63 | 16.31 | 5.1e-05 | ***** |
| haplotype 28 | | 150 vs 86 | 0.114 | 0.011 | 10.33 | 11.04 | 16.15 | 5.7e-05 | ***** |
| haplotype 29 | | 243 vs 159 | 0.105 | 0.029 | 7.81 | 3.96 | 16.04 | 6.0e-05 | ***** |
| haplotype 30 | | 240 vs 161 | 0.101 | 0.028 | 7.51 | 3.88 | 15.38 | 8.7e-05 | ***** |

TABLE 24

HAPLOTYPE ANALYSIS
PERMUTATION TEST RESULTS
Asthma

| PROTEIN MGST2 | 12-447/56 | 12-455/326 | 12-461/299 | 12-453/429 | 12-424/198 |
|---|---|---|---|---|---|
| | | | markers in bac | | |
| | | G<br>7.52E − 01<br>0.8(44 vs 45)<br>5.84E − 01<br>3.5(63 vs 60)<br>G<br>7.52E − 01<br>0.8(44 vs 45)<br>5.84E − 01<br>3.5(63 vs 60) | | C<br>5.27E − 01<br>−2.7(59 vs 62)<br>1.47E − 01<br>4.7(61 vs 56)<br>C<br>5.27E − 01<br>−2.7(59 vs 62)<br>1.47E − 01<br>4.7(61 vs 56) | T<br>7.52E − 02<br>−1(41 vs 40)<br>5.84E − 01<br>−1.7(59 vs 61)<br>T<br>7.52E − 01<br>−1(41 vs 40)<br>5.84E − 01<br>−1.7(59 vs 61) |
| | C<br>4.80e − 01<br>−3.1(52 vs 55)<br>7.52E − 01<br>−1(54 vs 55) | A<br>7.52e − 01<br>0.8(58 vs 55)<br>5.84E − 01<br>−2.4(56 vs 58) | T<br>6.55e − 01<br>1.6(64 vs 63)<br>2.73E − 01<br>3.5(63 vs 60) | T<br>5.27e − 01<br><2.7(41 vs 38)<br>1.47E − 01<br>4.7(39 vs 44) | |

| PROTEIN MGST2 | 12-464/363 | | MARKERS | | |
|---|---|---|---|---|---|
| | | | HAPLOTYPES (ALT vs US) | | |
| | | pvalue<br>diff all. Freq %<br>pvalue<br>diff all. Freq % | ALT+ vs ALT−<br><br>ALT vs caucasian US | | |
| | G | | HAPLOTYPES (ALT vs US) | | |
| | 4.80E − 01<br>−2.5(77 vs 80)<br>3.43E − 01<br>−2.5(79vs 81) | pvalue<br>diff all. Freq %<br>pvalue<br>diff all. Freq % | ALT+ vs ALT−<br><br>ALT vs caucasian US | | |
| | | | HAPLOTYPES (ALT vs US) | | |
| | | pvalue<br>diff all. Freq %<br>pvalue<br>diff all. Freq % | ALT+ vs ALT−<br><br>ALT vs caucasian US | | |

| HAPLOTYPE | sample sizes<br>cases vs | haplotype<br>frequencies | | | odds- |
|---|---|---|---|---|---|
| GCT | controls | cases | controls | p-excess | ratio |
| ALT+ vs ALT− | 60 vs 91 | 0.077 | 0.141 | −7.53 | 0.50 |
| ALT+ vs ALT−(1) | 60 vs 91 | 0.077 | 0.141 | −7.53 | 0.5 |
| ALT vs caucasian US | 151 vs 86 | 0.118 | 0.011 | 10.81 | 12.22 |
| ALT vs caucasian US(2) | 151 vs 86 | 0.118 | 0.011 | 10.81 | 12.22 |

| | | | | PERMUTATIONS | | |
|---|---|---|---|---|---|---|
| HAPLOTYPE<br>GCT | chi-S | | P value | Av.<br>Chi-S | Max<br>Chi-S | >iter/<br>no of iter. |
| ALT+ vs ALT− | 2.96 | | 8.3e − 02 * | 1.4 | 14.6 | 158/1000 |
| ALT+ vs ALT−(1) | 2.96 | | 8.3e − 02 * | 1.4 | 14.6 | 158/1000 |
| ALT vs caucasian US | 17.23 | | 3.2e − 05 **** | 2.2 | 19.5 | 3/1000 |
| ALT vs caucasian US(2) | | | | 2.2 | 22.6 | 31/10000 |
| | 17.23 | | 3.2e − 05 **** | 2.2 | 19.5 | 3/1000 |

| HAPLOTYPE | sample sizes<br>cases vs | haplotype<br>frequencies | | | odds- |
|---|---|---|---|---|---|
| GCTG | controls | cases | controls | p-excess | ratio |
| ALT+ vs ALT− | 56 vs 88 | 0.088 | 0.152 | −7.46 | 0.54 |
| ALT+ vs ALT−(1) | 56 vs 88 | 0.088 | 0.152 | −7.46 | 0.54 |
| ALT vs caucasian US | 144 vs 86 | 0.126 | 0.000 | 12.6 | 100 |
| ALT vs caucasian US(2) | 144 vs 86 | 0.126 | 0.000 | 12.6 | 100 |

TABLE 24-continued

HAPLOTYPE ANALYSIS
PERMUTATION TEST RESULTS
Asthma

| | | | | PERMUTATIONS | | |
|---|---|---|---|---|---|---|
| HAPLOTYPE GCTG | chi-S | | P value | Av. Chi-S | Max Chi-S | >iter/ no of iter. |
| ALT+ vs ALT− | 2.47 | 1.1e − 01 | * | 1.4 | 16.6 | 182/1000 |
| ALT+ vs ALT−(1) | 2.47 | 1.1e − 01 | * | 1.4 | 16.6 | 182/1000 |
| ALT vs caucasian US | 23.52 | 1.2e − 06 | ***** | 2.8 | 20.1 | 0/1000 |
| ALT vs caucasian US(2) | | | | 2.8 | 28.7 | 5/10000 |
| | 23.52 | 1.2e − 0.6 | ***** | 2.8 | 20.1 | 0/1000 |

| HAPLOTYPE CATT | sample sizes cases vs controls | haplotype frequencies cases | controls | p-excess | odds- ratio |
|---|---|---|---|---|---|
| ALT+ vs ALT− | 64 vs 102 | 0.139 | 0.075 | 7 | 2.01 |
| ALT+ vs ALT−(1) | 64 vs 102 | 0.139 | 0.075 | 7 | 2.01 |
| ALT vs caucasian US | 166 vs 92 | 0.101 | 0 | 10.09 | 100 |
| ALT vs caucasian US(2) | 166 vs 92 | 0.101 | 0 | 10.09 | 100 |

| | | | | PERMUTATIONS | | |
|---|---|---|---|---|---|---|
| HAPLOTYPE CATT | chi-S | | P value | Av. Chi-S | Max Chi-S | >iter/ no of iter. |
| ALT+ vs ALT− | 3.68 | 5.4e − 02 | * | 1.5 | 14.4 | 114/1000 |
| ALT+ vs ALT−(1) | 3.68 | 5.4e − 02 | * | 1.5 | 14.4 | 114/1000 |
| ALT vs caucasian US | 19.85 | 8.2e − 06 | ***** | 3.0 | 29.0 | 12/1000 |
| ALT vs caucasian US(2) | | | | 3.0 | 29.0 | 76/10000 |
| | 19.85 | 8.2e − 06 | ***** | 3.0 | 29.0 | 12/1000 |

TABLE 25

SINGLE POINT: ALLELIC ASSOCIATION ANALYSIS
(Zyflo secondary effects)
(89 ALT+ vs 208 ALT−)

| | SNP CHARACTERISTICS | | | | | | | ALT+ | | ALT− | | ASSOCIATION ANALYSIS | |
|---|---|---|---|---|---|---|---|---|---|---|---|---|---|
| Seq. ID No. | protein | Biallelic Marker ID | No. in protein | SNP local- ization | gene or bac size (kb) | fish mapping | Poly- morph- ism | sam- ple size | allele frequen- cy (%) | sample size | allele frequen- cy (%) | Diff of allele frequency (%) | pvalue (1df) |
| 21 | MGST2 | 12-458/ 196 | 1 | 3' gene | bac 145 | 4q28-3q31 | A/T | 83 | 77.71 | 194 | 83.25 | −5.5 | 1.21e − 01 |
| 5 | MGST2 | 12-426/ 154 | 3 | 3' gene | bac 145 | 4q28-3q31 | A/G | 85 | 60.59 | 188 | 58.78 | 1.8 | 6.55e − 01 |
| 9 | MGST2 | 12-441/ 233 | 4 | 3' gene | bac 145 | 4q28-3q31 | C/T | 87 | 60.34 | 198 | 65.91 | −5.6 | 1.92e − 01 |
| 1 | MGST2 | 12-421/ 140 | 7 | in B | bac 145 | 4q28-3q31 | A/G | 86 | 81.4 | 195 | 81.79 | −0.4 | 7.52e − 01 |
| 436 | MGST2 | 12-421/ 135 | 8 | in B | bac 145 | 4q28-3q31 | G/T | 88 | 81.82 | 194 | 87.37 | −5.6 | 7.83e − 02 |
| 13 | MGST2 | 12-453/ 429 | 9 | 5' gene | bac 145 | 4q28-3q31 | C/T | 88 | 59.09 | 199 | 61.81 | −2.7 | 5.27e − 01 |
| 12 | MGST2 | 12-447/ 58 | 10 | 5' gene | bac 145 | 4q28-3q31 | C/G | 89 | 52.25 | 198 | 55.3 | −3.1 | 4.80e − 01 |
| 25 | MGST2 | 12-461/ 299 | 11 | 5' gene | bac 145 | 4q28-3q31 | C/T | 88 | 64.2 | 199 | 62.56 | 1.6 | 6.55e − 01 |
| 3 | MGST2 | 12-424/ 198 | 12 | 5' gene | bac 145 | 4q28-3q31 | G/T | 80 | 58.75 | 180 | 59.72 | −1 | 7.52e − 01 |
| 14 | MGST2 | 12-454/ 363 | 13 | — | bac 145 | 4q28-3q31 | A/G | 83 | 77.11 | 194 | 79.64 | −2.5 | 4.80e − 01 |

TABLE 26

HAPLOTYPE ANALYSIS (MGST2)

89 ALT+ vs 208 ALT−

| MARKERS | | | 12-421/135 | 12-421/140 | 12-430/80 | 12-441/233 | 12-442/133 | 12-447/58 | 12-455/326 | 12-451/299 | 12-453/429 | 12-424/198 | 12-454/363 | 12-458/196 | 12-426/154 |
|---|---|---|---|---|---|---|---|---|---|---|---|---|---|---|---|
| MGST2 | | | InB | | | | | | markers in bac | | | | | | |
| size (cases/controls) | | | 88 vs 194 | 86 vs 195 | 56 vs 97 | 87 vs 198 | 68 vs 104 | 89 vs 198 | 65 vs 102 | 58 vs 199 | 88 vs 199 | 80 vs 180 | 83 vs 194 | 83 vs 194 | 85 vs 188 |
| allelic frequency % (case/controls) | | | 18/12 (T) | 18/18 (G) | 91/91 (G) | 39/34 (C) | 92/91 (G) | 47/44 (G) | 56/55 (A) | 64/62 (T) | 40/38 (T) | 41/40 (T) | 22/20 (A) | 22/16 (T) | 60/58 (A) |
| diff freq. all. (cases-controls) | | | 5.6 | 0.4 | 0.4 | 5.6 | 1.3 | 3.1 | 0.8 | 1.6 | 2.7 | 1.0 | 2.5 | 5.5 | 1.8 |
| pvalue | | | 7.8e-02 | 7.5e-01 | 7.5e-01 | 1.9e-01 | 6.6e-01 | 4.8e-01 | 7.5e-01 | 6.6e-01 | 5.3e-01 | 7.5e-01 | 4.8e-01 | 1.2e-01 | 6.6e-01 |
| | | | 1.5 | 1.0 | 1.1 | 1.3 | 1.2 | 1.1 | 1.0 | 1.1 | 1.1 | 1.0 | 1.2 | 1.4 | 1.1 |
| Test Hardy Weinberg Equilibrium | cases vs | | −0.01 HW | 0.00 HW | 0.83 | 0.02 HW | 0.85 | −0.04 HW | −0.02 HW | 0.01 HW | −0.01 HW | 0.04 HW | −0.00 HW | 0.03 HW | −0.00 HW |
| | controls | | 0.00 HW | −0.00 HW | 0.00 HW | 0.01 HW | 0.00 HW | 0.01 HW | 0.03 HW | 0.01 HW | −0.03 HW | 0.01 HW | 0.00 HW | −0.00 HW | 0.03 HW |
| haplotype 1 | PT2 | 77 vs 170 | | | | | | | | | | | | | A |
| haplotype 2 | | 86 vs 198 | | | | | | | | | | | | | |
| haplotype 3 | | 81 vs 190 | | | | | | | | | | | | | |
| haplotype 4 | | 87 vs 198 | T | A | | | | | | | | | | | |
| haplotype 5 | | 86 vs 190 | | | | | | | | | | | | T | |
| haplotype 6 | PT3 | 86 vs 198 | | | | C | | | | T | T | | | | |
| haplotype 7 | | 86 vs 197 | | | | C | | C | | | T | | | | A |
| haplotype 8 | | 79 vs 179 | | A | | C | | | | | C | | | | |
| haplotype 9 | | 81 vs 190 | | | | | | | | | T | | | T | A |
| haplotype 10 | | 77 vs 170 | | | | | | | | | T | T | | T | A |
| haplotype 11 | | 77 vs 170 | | | | | | | | | T | T | | T | A |
| haplotype 12 | | 81 vs 189 | | A | | C | | G | | | | | | | |
| haplotype 13 | | 84 vs 188 | | | | | | | A | | | T | | | A |
| haplotype 14 | | 75 vs 166 | T | | | | | | | | | T | | T | A |
| haplotype 15 | | 86 vs 189 | | | | | | | A | | T | T | | T | A |
| haplotype 16 | | 83 vs 187 | | | | | | | A | | T | T | T | T | A |
| haplotype 17 | | 59 vs 91 | | | | | | | | | | | | | |
| haplotype 18 | | 73 vs 167 | | | | | | | | T | | | T | | A |
| haplotype 19 | PT4 | 83 vs 187 | | | | | | | | | | | | | A |
| haplotype 20 | | 86 vs 197 | | | | C | | | | | | | | | |
| haplotype 21 | | 83 vs 186 | | | | | | | | | | | | | |
| haplotype 22 | | 64 vs 98 | | | G | | G | | | | | T | | | |
| haplotype 23 | | 61 vs 95 | | | | C | | G | | | | | | T | A |
| haplotype 24 | | 56 vs 85 | | A | G | | G | | A | | T | T | | T | A |
| haplotype 25 | | 79 vs 179 | | | | | | G | | | | | | | |
| haplotype 26 | | 85 vs 194 | | A | | C | G | G | A | | T | T | | T | A |
| haplotype 27 | | 59 vs 87 | | | | | | G | A | | | | | | |
| haplotype 28 | | 81 vs 183 | | | | | | G | | | | T | | T | A |
| haplotype 29 | | 77 vs 170 | | A | | C | G | G | A | T | T | T | T | T | A |
| haplotype 30 | | 56 vs 83 | | | | | | | | | | | | | A |
| haplotype 31 | | 64 vs 99 | G | | | | | | | T | T | T | | T | A |

TABLE 26-continued

| | | | ESTIMATED FREQUENCIES | | | | | |
|---|---|---|---|---|---|---|---|---|
| | | | haplotype frequencies | | p-excess | Odds ratio | Chi-S | Pvalue (1 df) | |
| | | | cases | controls | | | | | |
| haplotype 1 | PT2 | 77 vs 170 | 0.301 | 0.180 | 14.75 | 1.96 | 9.11 | 2.4e-03 | *** |
| haplotype 2 | | 86 vs 198 | 0.175 | 0.096 | 8.69 | 1.99 | 7.00 | 7.7e-03 | ** |
| haplotype 3 | | 81 vs 190 | 0.185 | 0.106 | 8.78 | 1.91 | 6.20 | 1.2e-02 | ** |
| haplotype 4 | | 87 vs 198 | 0.281 | 0.196 | 10.55 | 1.60 | 5.03 | 2.4e-02 | ** |
| haplotype 5 | | 86 vs 190 | 0.186 | 0.117 | 7.82 | 1.72 | 4.73 | 2.8e-02 | ** |
| haplotype 6 | | 86 vs 198 | 0.157 | 0.049 | 11.34 | 3.63 | 18.68 | 1.5e-05 | ****** |
| haplotype 7 | PT3 | 86 vs 197 | 0.150 | 0.054 | 10.15 | 3.08 | 14.44 | 1.4e-04 | **** |
| haplotype 8 | | 79 vs 179 | 0.128 | 0.046 | 8.59 | 3.04 | 11.15 | 8.2e-04 | *** |
| haplotype 9 | | 81 vs 190 | 0.134 | 0.053 | 8.51 | 2.74 | 10.33 | 1.3e-03 | *** |
| haplotype 10 | | 77 vs 170 | 0.159 | 0.069 | 9.69 | 2.55 | 9.60 | 1.7e-03 | *** |
| haplotype 11 | | 77 vs 170 | 0.301 | 0.180 | 14.74 | 1.96 | 9.08 | 2.6e-03 | *** |
| haplotype 12 | | 81 vs 189 | 0.124 | 0.052 | 7.67 | 2.61 | 8.83 | 2.9e-03 | *** |
| haplotype 13 | | 84 vs 188 | 0.193 | 0.105 | 9.67 | 2.04 | 7.90 | 4.7e-03 | *** |
| haplotype 14 | | 75 vs 166 | 0.217 | 0.122 | 10.88 | 2.00 | 7.34 | 6.5e-03 | *** |
| haplotype 15 | | 86 vs 189 | 0.114 | 0.051 | 6.71 | 2.41 | 7.29 | 6.9e-03 | *** |
| haplotype 16 | | 83 vs 187 | 0.164 | 0.087 | 8.40 | 2.05 | 6.86 | 8.6e-03 | *** |
| haplotype 17 | | 59 vs 91 | 0.189 | 0.087 | 11.24 | 2.46 | 6.81 | 8.6e-03 | *** |
| haplotype 18 | | 73 vs 167 | 0.283 | 0.179 | 12.74 | 1.82 | 6.68 | 9.6e-03 | ** |
| haplotype 19 | PT4 | 83 vs 187 | 0.141 | 0.028 | 11.64 | 5.75 | 25.13 | 5.2e-07 | ******* |
| haplotype 20 | | 86 vs 197 | 0.154 | 0.043 | 11.62 | 4.04 | 20.84 | 4.8e-06 | ***** |
| haplotype 21 | | 83 vs 186 | 0.140 | 0.047 | 9.80 | 3.32 | 14.32 | 1.5e-04 | **** |
| haplotype 22 | | 64 vs 98 | 0.147 | 0.039 | 11.27 | 4.26 | 12.11 | 4.8e-04 | *** |
| haplotype 23 | | 61 vs 95 | 0.203 | 0.072 | 14.08 | 3.26 | 11.72 | 5.9e-04 | *** |
| haplotype 24 | | 56 vs 85 | 0.239 | 0.092 | 16.23 | 3.10 | 11.45 | 7.0e-04 | *** |
| haplotype 25 | | 79 vs 179 | 0.130 | 0.048 | 8.67 | 2.99 | 11.05 | 8.6e-04 | *** |
| haplotype 26 | | 85 vs 194 | 0.113 | 0.040 | 7.65 | 3.07 | 10.91 | 9.1e-04 | *** |
| haplotype 27 | | 59 vs 87 | 0.207 | 0.080 | 13.88 | 3.02 | 10.06 | 1.5e-03 | *** |
| haplotype 28 | | 81 vs 183 | 0.121 | 0.047 | 7.76 | 2.77 | 9.41 | 2.1e-03 | *** |
| haplotype 29 | | 77 vs 170 | 0.159 | 0.071 | 9.53 | 2.49 | 9.39 | 2.2e-03 | *** |
| haplotype 30 | | 56 vs 83 | 0.208 | 0.082 | 13.70 | 2.93 | 9.17 | 2.4e-03 | *** |
| haplotype 31 | | 64 vs 99 | 0.173 | 0.067 | 11.40 | 2.92 | 9.07 | 2.6e-03 | *** |

TABLE 27

HAPLOTYPE ANALYSIS
PERMUTATION TEST RESULTS
Zyflo secondary effects

| PROTEIN MGST2 | 12-441/233 | 12-461/299 | 12-453/429 | 12-426/154 | | |
|---|---|---|---|---|---|---|
| | markers in bac | | | | MARKERS | |
| | C | T | T | | HAPLOTYPES (ALT+ vs ALT−) | |
| | 1.92E − 01 | 6.55E − 01 | 5.27E − 01 | | pvalue | ALT+ vs ALT− |
| | −5.6(40 vs 34) | 1.6(64 vs 63) | −2.7(41 vs 38) | | diff all. Freq % | |
| | 7.52E − 01 | 2.73E − 01 | 1.47E − 1 | | pvalue | ALT vs caucasian US |
| | −0.3(36 vs 35) | 3.5(63 vs 60) | 4.7(39 vs 44) | | diff all. Freq % | |
| | C | T | T | A | HAPLOTYPES (ALT+ vs ALT−) | |
| | 1.92E − 01 | 6.55E − 01 | 5.27E − 01 | 6.55E − 01 | pvalue | ALT+ vs ALT− |
| | −5.6(40 vs 34) | 1.6(64 vs 63) | −2.7(41 vs 38) | 1.8(61 vs 59) | diff all. Freq % | |
| | 7.52E − 01 | 2.73E − 01 | 1.47E − 01 | 6.55E − 01 | pvalue | ALT vs caucasian US |
| | −0.3(36 vs 35) | 3.5(63 vs 60) | 4.7(39 vs 44) | 1.3(59 vs 58) | diff all. Freq % | |

| | sample size | haplotype | | | | | | PERMUTATIONS | | |
|---|---|---|---|---|---|---|---|---|---|---|
| HAPLOTYPE | cases vs | frequencies | | odds- | | | | Av. | Max | >iter/ |
| CTT | controls | cases | controls | p-excess | ratio | chi-S | P value | Chi-S | Chi-S | nb of iter. |
| ALT+ vs ALT− | 86 vs 198 | 0.157 | 0.049 | 11.34 | 3.63 | 18.68 | 1.5e − 05 | ***** | 1.9 | 18.9 | 1/1000 |
| ALT+ vs ALT−(1) | | | | | | | | | 1.9 | 25.4 | 12/10000 |
| ALT+ vs ALT−(2) | 86 vs 104 | 0.157 | 0.088 | 7.54 | 1.93 | 4.26 | 3.8e − 02 | * | 1.1 | 16.5 | 52/1000 |
| | 86 vs 94 | 0.157 | 0.042 | 11.91 | 4.19 | 13.36 | 2.5e − 04 | **** | 1.5 | 15.4 | 3/1000 |
| ALT vs caucasian US | 284 vs 176 | 0.092 | 0.071 | 2.2 | 1.32 | 1.18 | 2.7e − 01 | * | 2.1 | 20.9 | 479/1000 |
| ALT vs caucasian US(2) | 284 vs 94 | 0.092 | 0.047 | 4.67 | 2.04 | 3.77 | 5.1e − 02 | * | 1.9 | 17.3 | 158/1000 |
| ALT vs caucasian US(3) | 284 vs 82 | 0.092 | 0.116 | −2.79 | 0.77 | 0.88 | 3.4e − 02 | | 1.8 | 17.7 | 498/1000 |

| | sample size | haplotype | | | | | | PERMUTATIONS | | |
|---|---|---|---|---|---|---|---|---|---|---|
| HAPLOTYPE | cases vs | frequencies | | odds- | | | | Av. | Max | >iter/ |
| CTTA | controls | cases | controls | p-excess | ratio | chi-S | P value | Chi-S | Chi-S | no of iter. |
| ALT+ vs ALT− | 83 vs 187 | 0.141 | 0.028 | 11.64 | 5.75 | 25.13 | 5.2e − 07 | ****** | 2.6 | 25.2 | 1/1000 |
| ALT+ vs ALT−(1) | | | | | | | | | 2.5 | 35 | 7/10000 |
| ALT+ vs ALT−(2) | 83 vs 98 | 0.141 | 0.066 | 8.03 | 2.33 | 5.61 | 1.7e − 02 | ** | 1.7 | 17.4 | 59/1000 |
| | 83 vs 89 | 0.141 | 0.034 | 11.03 | 4.6 | 12.42 | 4.1e − 04 | *** | 1.7 | 18.3 | 3/1000 |
| ALT vs caucasian US | 270 vs 167 | 0.082 | 0.058 | 2.61 | 1.46 | 1.85 | 1.7e − 01 | * | 2.7 | 25.9 | 438/1000 |
| ALT vs caucasian US(2) | 270 vs 89 | 0.082 | 0.023 | 6.12 | 3.89 | 7.61 | 5.5e − 03 | ** | 2.7 | 30.3 | 92/1000 |
| ALT vs caucasian US(3) | 270 vs 78 | 0.082 | 0.110 | −3.06 | 0.73 | 1.11 | 2.7e − 01 | * | 2.3 | 17.8 | 499/1000 |

TABLE 28

SINGLE POINT: ALLELIC ASSOCIATION ANALYSIS
(Zyflo secondary effects)
(89 ALT + vs 208 ALT−)

| | | | | | | | | ALT+ | | ALT− | | ASSOCIATION ANALYSIS | |
|---|---|---|---|---|---|---|---|---|---|---|---|---|---|
| | | | | | | | | allele | | allele | | Diff of allele | |
| | | SNP CHARACTERISTICS | | | | | | | | | | | |
| Seq. ID No. | code | pro-tein | Biallelic Marker ID | SNP locali-zation | gene or bac size(kb) | fish map-ping | Poly-mor-phism | sam-ple size | fre-quency (%) & | sam-ple size | fre-quency (%) & | fre-quency (%) $ | p-value (1df) # |
| 300 | G25.2 | UGT1A7 | 12-121/326 | 5′ gene | bac 130 | 2q37 | A/G | 85 | 73.53 | 199 | 69.1 | 4.4 | 2.73E − 01 |
| 309 | G25.2 | UGT1A7 | 12-128/225 | 5′ gene | bac 130 | 2q37 | A/C | 89 | 58.43 | 199 | 51.01 | 7.4 | 9.43E − 02 |
| 336 | G25.2 | UGT1A7 | 12-148/311 | 5′ gene | bac 130 | 2q37 | A/G | 89 | 57.3 | 199 | 50.25 | 7.1 | 1.14E − 01 |
| 345 | G25.2 | UGT1A7 | 12-156/91 | 5′ gene | bac 130 | 2q37 | A/G | 78 | 52.56 | 192 | 49.22 | 3.3 | 4.80E − 01 |
| 322 | G25.2 | UGT1A7 | 12-139/380 | in bac | bac 130 | 2q37 | A/G | 88 | 78.41 | 198 | 79.55 | −1.1 | 7.52E − 01 |
| 323 | G25.2 | UGT1A7 | 12-140/134 | in bac | bac 130 | 2q37 | G/T | 81 | 51.85 | 196 | 56.89 | −5 | 2.73E − 01 |
| 329 | G25.2 | UGT1A7 | 12-142/321 | in bac | bac 130 | 2q37 | A/G | 85 | 55.88 | 192 | 50.78 | 5.1 | 2.54E − 01 |

TABLE 29

HAPLOTYPE ANALYSIS
G25.2 UGT1A7 (2q37)

CASES (89 ALT+) vs CONTROLS (208 ALT−)

| MARKERS PROTEIN UGT1A7 G25.2 | | | 12-121/326 | 12-128/226 | 12-148/311 | 12-156/91 | 12-139/380 | 12-140/134 | 12-142/321 |
|---|---|---|---|---|---|---|---|---|---|
| | | | \multicolumn{4}{c|}{5′gene} | | In Bac | |
| cases/controls | | | 85 vs 199 | 89 vs 199 | 89 vs 199 | 78 vs 192 | 88 vs 196 | 81 vs 196 | 85 vs 192 |
| frequency % (case/controls) | | | 73/69 (G) | 58/51 (A) | 57/50 (G) | 52/49 (A) | 21/20 (A) | 48/43 (T) | 55/50 (A) |
| diff freq. all. (cases - controls) | | | 4.4 | 7.4 | 7.1 | 3.3 | 1.1 | 5.0 | 5.1 |
| Pvalue | | | 2.7e-01 | 9.4e-02 | 1.1e-01 | 4.6e-01 | 7.5e-01 | 2.7e-01 | 2.5e-01 |
| Odd ratio | | | 1.2 | 1.4 | 1.3 | 1.1 | 1.1 | 1.2 | 1.2 |
| Test Hardy Weinberg | cases vs controls | | 0.04 HW | -0.00 HW | 0.01 HW | -0.07 HWE | 0.01 HW | 0.03 HW | 0.05 HWE |
| | | | -0.01 HW | 0.00 HW | -0.00 HW | -0.01 HW | 0.01 HW | -0.01 HW | -0.00 HW |
| haplotype 1 | PT2 | 81 vs 196 | A | | | | | T | |
| haplotype 2 | | 78 vs 196 | G | | | | | T | |
| haplotype 3 | | 85 vs 199 | G | A | | | | | |
| haplotype 4 | | 85 vs 199 | G | | G | | | | |
| haplotype 5 | | 88 vs 198 | A | | | A | | | |
| haplotype 6 | PT3 | 61 vs 196 | | | G | | | T | |
| haplotype 7 | | 81 vs 192 | G | | | | | | A |
| haplotype 8 | | 72 vs 185 | G | | | G | | | A |
| haplotype 9 | | 80 vs 191 | G | | | | A | | A |
| haplotype 10 | | 71 vs 188 | | | | A | G | T | |
| haplotype 11 | | 77 vs 190 | | A | | | | T | A |
| haplotype 12 | PT4 | 71 vs 188 | A | | A | G | T | | |
| haplotype 13 | | 71 vs 188 | | G | A | G | T | | A |
| haplotype 14 | | 74 vs 190 | G | A | | | T | | A |
| haplotype 15 | | 76 vs 189 | A | | | G | T | | A |
| haplotype 16 | | 77 vs 195 | G | A | | G | T | | |

| HAPLOTYPE FREQUENCY TEST | | | | | | | | | OMNIBUS LR TEST | | | |
|---|---|---|---|---|---|---|---|---|---|---|---|---|
| Estimation frequency of haplotype | | | | Statistical test | | | | | Likelihood Ratio | | omnibus test | |
| frequency cases (%) | frequency controls (%) | frequency difference | p-excess | Odds ratio | Chi-S | pvalue (1 df) | | Pvalue (100 permutations) | No. of permutations | Likelihood Ratio Test | Pvalue (# df) | Pvalue (100 permutations) |
| 30.1 | 22.8 | 7.3 | 9.42 | 1.46 | 3.24 | (8.9e-02) | *** | (7.00e-02) | (7/100) | 4.05 | (2.5e-01) 3df | (2.1e-01) NS |
| 38.5 | 30.6 | 7.9 | 11.30 | 1.42 | 3.11 | (7.4e-02) | * | (5.00e-02) | (5/100) | 2.63 | (4.4e-01) 3df | (4.7e-01) NS |
| 58.8 | 51 | 7.8 | 15.96 | 1.37 | 2.93 | (8.3e-02) | * | (4.00e-02) | (4/100) | 2.97 | (3.9e-01) 3df | (2.1e-01) NS |
| 57.6 | 50.3 | 7.3 | 14.87 | 1.35 | 2.61 | (1.0e-01) | * | (3.00e-02) | (3/100) | 2.62 | (4.4e-01) 3df | (2.6e-01) NS |
| 12.3 | 8.3 | 4 | 4.45 | 1.56 | 2.36 | (1.2e-01) | * | (2.10e-01) | (21/100) | 3.34 | (3.3e-01) 3df | (4.1e-01) NS |
| 29 | 22.8 | 8.2 | 8.01 | 1.36 | 2.36 | (1.2e-01) | * | (1.20e-01) | (12/100) | 3.23 | (3.5e-01) 3df | (2.8e-01) NS |
| 42 | 35.4 | 6.5 | 10.27 | 1.32 | 2.14 | (1.4e-01) | * | (8.00e-02) | (8/100) | 2.49 | (4.8e-01) 3df | (4.9e-01) NS |
| 14.1 | 5.2 | 6.9 | 9.35 | 2.98 | 11.45 | (7.0e-04) | *** | (<1.0e-02) | (0/100) | 8.15 | (3.2e-01) 7df | (1.5e-01) NS |
| 11.6 | 5.4 | 6.2 | 6.49 | 2.28 | 8.33 | (1.1e-02) | ** | (7.00e-02) | (7/100) | 6.82 | (4.4e-01) 7df | (5.7e-01) NS |
| 26.2 | 17.2 | 9 | 10.87 | 1.71 | 5.27 | (2.1e-02) | ** | (1.00e-02) | (1/100) | 7.69 | (3.6e-01) 7df | (4.3e-01) NS |
| 19.5 | 11.9 | 7.6 | 8.51 | 1.79 | 5.19 | (2.3e-02) | ** | (2.00e-02) | (2/100) | 6.31 | (4.9e-01) 7df | (6.1e-01) NS |
| 27.4 | 17 | 10.4 | 12.60 | 1.65 | 7.08 | (7.7e-03) | ** | (2.00e-02) | (2/100) | 28.05 | (2.1e-02) 15df | (2.0e-02) S |
| 27.2 | 17.4 | 9.8 | 11.84 | 1.77 | 8.15 | (1.3e-02) | ** | (2.00e-02) | (2/100) | 27.17 | (2.3e-02) 15df | (1.0e-02) S |
| 19.9 | 12.3 | 7.6 | 8.65 | 1.77 | 4.97 | (2.5e-02) | ** | (4.00e-02) | (4/100) | 8.65 | (8.9e-01) 15df | (7.7e-01) NS |
| 15.2 | 8.7 | 6.5 | 7.10 | 1.88 | 4.83 | (2.7e-02) | ** | (1.00e-01) | (10/100) | 13.83 | (5.3e-01) 15df | (7.8e-01) NS |
| 26 | 17.7 | 8.3 | 10.10 | 1.63 | 4.76 | (2.8e-02) | ** | (4.00e-02) | (4/100) | 10.64 | (7.7e-01) 15df | (6.7e-01) NS |

TABLE 30

Multipoint analysis: HAPLOTYPE FREQUENCY TEST-OMNIBUS LR TEST
G25.2 UGT1A7 (2q37)

| MARKERS | | 12-128/225 | 12-156/91 5' gene | 12-139/380 | 12-140/134 Bac |
|---|---|---|---|---|---|
| HAPLOTYPE 1 | | A | A | G | T |
| pvalue (1df) | ALT+ vs ALT− (2 screening) | 9.4e − 02 | 4.8e − 01 | 7.5e − 01 | 2.7e − 01 |
| % frequency difference (sample size) | | 7.4(89 vs 199) | 3.3(78 vs 192) | 1.1(88 vs 198) | 5(81 vs 196) |

| | | HAPLOTYPE FREQUENCY TEST | | | | | | | OMNIBUS LR TEST | | |
|---|---|---|---|---|---|---|---|---|---|---|---|
| | | Estimation frequency of haplotype | | | | | Statistical test | | Pvalue | Likelihood Ratio | |
| Zyflo secondary effects | sample sizes cases vs controls | frequency cases (%) | frequency controls (%) | frequency difference(%) | p-excess | Odds ratio | Chi-S | pvalue (1df) | (100 permutations) | No. of permutations | Likelihood Ratio Test | Pvalue (# df) | omnibus test Pvalue (100 permutations) |
| ALT+ vs ALT− (2 screening) | 71 vs 188 | 27.4 | 17 | 10.4 | 1.85 | 12.60 | 7.09 | 7.7e − 03 | ** 1.90e − 02 | 19/1000 | 28.01 | (2.1e − 02) | 15df (1.2e − 02) S |
| ALT+(1) vs ALT−(1) | 52 vs 97 | 24.9 | 12.9 | 12 | 2.23 | 13.75 | 6.83 | 8.6e − 03 | ** 3.30e − 02 | 33/1000 | 24.05 | (6.3e − 02) | 15df (5.7e − 02) NS |
| ALT+(1) vs ALT−(2) | 52 vs 91 | 24.9 | 22.2 | 2.7 | 1.16 | 3.48 | 0.27 | 5.8e − 01 | 6.15e − 01 | 615/1000 | 25.69 | (4.1e − 02) | 15df (1.5e − 02) S |
| ALT vs US(2) | 259 ncv 89 | 20.3 | 20.8 | 0.5 | 0.97 | −0.62 | 0.02 | 7.5e − 01 | 9.00e − 01 | 900/1000 | 15.14 | (4.4e − 01) | 15df (3.9e − 01) NS |

TABLE 31

SINGLE POINT: ALLELIC ASSOCIATION ANALYSIS (Zyflo secondary effects)
(89 ALT+ vs 208 ALT−)

| | | SNP CHARACTERISTICS | | | | | | | ALT+ | | ALT− | | Diff | ASSOCIATION ANALYSIS |
|---|---|---|---|---|---|---|---|---|---|---|---|---|---|---|
| Seq. ID No. | code | protein | Biallelic Marker ID | No. in protein | SNP localization | SNP change | gene or bac size(kb) | fish mapping | Polymorphism | sample size | allele frequency (%) & | sample size | allele frequency (%) & | of allele frequency (%) $ | pvalue (1df) # |
| 380 | G40.3 | UGT2B4 | 12-653/423 | | inB | | bac 120 | 4q13.3-q21 | A/T | 82 | 81.1 | 193 | 72.3 | 8.8 | 2.85E − 02 |
| 351 | G40.3 | UGT2B4 | 10-470/25 | 2 | in2 | | bac 120 | 4q13.3-q21 | A/T | 87 | 51.15 | 191 | 41.88 | 9.3 | 4.04E − 02 |
| 352 | G40.3 | UGT2B4 | 10-471/84 | 3 | ex5 | G −> A | bac 120 | 4q13.3-q21 | A/T | 84 | 81.55 | 194 | 72.68 | 8.9 | 2.53E − 02 |
| 353 | G40.3 | UGT2B4 | 10-471/85 | 3 | ex5 | | bac 120 | 4q13.3-q21 | A/C | 89 | 80.3 | 199 | 72.6 | 7.7 | 4.55E − 02 |
| 357 | G40.3 | UGT2B4 | 12-637/219 | 6 | 3' UTR | | bac 120 | 4q13.3-q21 | C/T | 82 | 72.56 | 189 | 62.96 | 9.6 | 3.02E − 02 |
| 358 | G40.3 | UGT2B4 | 12-639/95 | 7 | in bac | | bac 120 | 4q13.3-q21 | C/T | 82 | 64.02 | 189 | 59.79 | 4.2 | 3.43E − 01 |
| 377 | G40.3 | UGT2B4 | 12-652/203 | 8 | in bac | | bac 120 | 4q13.3-q21 | A/C | 88 | 50 | 199 | 59.55 | −9.5 | 3.20E − 02 |
| 369 | G40.3 | UGT2B4 | 12-642/417 | 9 | in bac | | bac 120 | 4q13.3-q21 | A/G | 86 | 71.51 | 194 | 78.61 | −7.1 | 6.52E − 02 |

TABLE 32

HAPLOTYPE ANALYSIS

CASES (89 ALT+) vs CONTROLS (208 ALT-)

| MARKERS PROTEIN UGT2B4 (G40.3) | | | 12-653/423 inB | 10-470/25 in2 | 10-471/84 ex5 | 10-471/85 | 12-637/219 3'UTR | 12-639/95 | 12-652/203 In Bac | 12-642/417 |
|---|---|---|---|---|---|---|---|---|---|---|
| cases/controls | | | 82 vs 193 | 87 vs 191 | 84 vs 194 | 89 vs 199 | 85 vs 190 | 86 vs 190 | 88 vs 199 | 85 vs 196 |
| frequency % (case/controls) | | | 81/72 (A) | 51/41 (T) | 81/72 (T) | 80/72 (C) | 72/62 (T) | 64/60 (T) | 50/40 (C) | 28/21 (G) |
| diff freq. all. (cases - controls) | | | 8.8 | 9.3 | 8.9 | 7.7 | 10.3 | 4.5 | 9.5 | 6.8 |
| Pvalue | | | 2.9e-02 | 4.0e-02 | 2.5e-02 | 4.5e-02 | 1.8e-02 | 2.9e-01 | 3.2e-02 | 7.8e-02 |
| Odd ratio | | | 1.6 | 1.4 | 1.7 | 1.5 | 1.6 | 1.2 | 1.5 | 1.4 |
| Test Hardy Weinberg | cases vs | | -0.01 HW | 0.01 HW | -0.02 HW | -0.02 HW | -0.00 HW | -0.01 HW | -0.05 HW | -0.02 HW |
| | controls | | -0.01 HW | 0.01 HW | -0.01 HW | -0.01 HW | -0.02 HW | -0.01 HW | 0.01 HW | 0.00 HW |
| haplotype 1 | PT2 | 86 vs 191 | | | T | | | | C | |
| haplotype 2 | | 83 vs 182 | | | | | T | | | |
| haplotype 3 | | 81 vs 185 | | | T | | T | | | |
| haplotype 4 | | 84 vs 190 | | A | | | | | | G |
| haplotype 5 | | 85 vs 190 | | | | C | T | | | |
| haplotype 7 | | 88 vs 199 | | | | C | | | C | |
| haplotype 8 | | 79 vs 184 | A | | | | T | | | |
| haplotype 9 | | 80 vs 185 | A | T | | | | | | |
| haplotype 11 | | 82 vs 193 | A | | | | | | C | |
| haplotype 12 | | 84 vs 194 | | | T | | | | C | |
| haplotype 13 | | 84 vs 194 | | T | C | | | | | |
| haplotype 14 | PT3 | 84 vs 183 | | | | | T | | C | |
| haplotype 15 | | 83 vs 182 | | T | | | T | | C | |
| haplotype 16 | | 84 vs 190 | | | | | | | C | A |
| haplotype 17 | | 80 vs 185 | A | T | | | | | C | |
| haplotype 18 | | 86 vs 191 | | | | C | | | C | |
| haplotype 20 | | 82 vs 186 | | T | | | T | | C | |
| haplotype 21 | | 77 vs 176 | A | T | T | | T | | C | |
| haplotype 22 | | 79 vs 177 | | | | C | | | C | |
| haplotype 23 | | 83 vs 182 | | T | | C | T | | | A |
| haplotype 25 | | 82 vs 181 | | T | | | T | | | A |
| haplotype 27 | | 85 vs 190 | | | | C | T | | C | |
| haplotype 28 | | 81 vs 185 | | T | | C | | | | |
| haplotype 30 | | 80 vs 184 | A | | | | | | C | |
| haplotype 31 | | 81 vs 185 | | | | | T | | C | |
| haplotype 32 | | 79 vs 184 | A | | | | T | | | |
| haplotype 33 | | 75 vs 179 | A | T | | | T | | | |
| haplotype 34 | | 86 vs 190 | | | | C | | | | |
| haplotype 35 | PT4 | 78 vs 177 | A | T | | | T | | C | |
| haplotype 36 | | 77 vs 176 | A | T | | | T | | C | |
| haplotype 37 | | 83 vs 182 | | T | C | | T | | C | |
| haplotype 38 | | 84 vs 183 | | T | | | | T | C | |
| haplotype 39 | | 79 vs 177 | | T | T | | T | | C | |
| haplotype 40 | | 80 vs 179 | | T | T | | | T | C | |
| haplotype 41 | | 80 vs 185 | A | T | C | | | | C | |
| haplotype 42 | | 76 vs 180 | A | T | T | | | | C | |

TABLE 32-continued

HAPLOTYPE ANALYSIS

| HAPLOTYPE FREQUENCY TEST ||||||||| OMNIBUS LR TEST |||
| Estimation frequency of haplotype ||| Statistical test ||||||  Likelihood Ratio || omnibus test |
| frequency cases (%) | frequency controls (%) | frequency difference | p-excess | Odds ratio | Chi-S | pvalue (1 df) | | Pvalue (100 permutations) | No. of permutations | Likelihood Ratio Test | Pvalue (# df) | | Pvalue (100 permutations) | |
|---|---|---|---|---|---|---|---|---|---|---|---|---|---|---|
| 30.3 | 19.2 | 11.1 | 13.71 | 1.83 | 8.32 | (3.8e-03) | ** | (2.00e-02) | (2/100) | 7.60 | (5.3e-02) | 3df | (5.0e-02) | S |
| 50.6 | 38.7 | 11.9 | 19.43 | 1.62 | 6.62 | (9.6e-03) | ** | (<1.0e-02) | (0/100) | 11.10 | (1.1e-02) | 3df | (1.0e-02) | S |
| 73.5 | 62.7 | 10.8 | 28.83 | 1.65 | 5.80 | (1.5e-02) | ** | (<1.0e-02) | (0/100) | 6.62 | (8.2e-02) | 3df | (1.0e-02) | S |
| 15.6 | 8.7 | 6.9 | 7.50 | 1.93 | 5.65 | (1.7e-02) | ** | (5.00e-02) | (5/100) | 9.82 | (1.9e-02) | 3df | (2.0e-02) | S |
| 72.3 | 62.6 | 9.7 | 25.87 | 1.56 | 4.87 | (2.7e-02) | ** | (3.00e-02) | (3/100) | 8.14 | (4.2e-02) | 3df | (6.0e-02) | NS |
| 50 | 40.5 | 9.5 | 16.03 | 1.47 | 4.53 | (3.2e-02) | * | (2.00e-02) | (2/100) | 5.52 | (1.3e-01) | 3df | (6.0e-02) | NS |
| 72 | 62.5 | 9.5 | 25.40 | 1.54 | 4.43 | (3.4e-02) | * | (1.00e-02) | (1/100) | 11.39 | (9.7e-03) | 3df | (1.0e-02) | S |
| 51.2 | 41.4 | 9.8 | 16.88 | 1.49 | 4.43 | (3.4e-02) | * | (4.00e-02) | (4/100) | 5.95 | (1.1e-01) | 3df | (9.0e-02) | NS |
| 50.6 | 40.9 | 9.7 | 16.38 | 1.48 | 4.38 | (3.6e-02) | * | (4.00e-02) | (4/100) | 6.19 | (1.0e-01) | 3df | (4.0e-02) | S |
| 50 | 40.5 | 9.5 | 16.02 | 1.47 | 4.34 | (3.6e-02) | * | (1.00e-02) | (1/100) | 6.36 | (9.4e-02) | 3df | (1.0e-02) | S |
| 81 | 72.7 | 8.3 | 30.28 | 1.60 | 4.30 | (3.8e-02) | * | (<1.0e-02) | (0/100) | 7.40 | (8.0e-02) | 3df | (2.0e-02) | S |
| 22 | 11.3 | 10.7 | 12.00 | 2.20 | 10.41 | (1.2e-03) | *** | (<1.0e-02) | (0/100) | 10.02 | (1.8e-01) | 7df | (2.2e-01) | NS |
| 29.9 | 18.1 | 11.8 | 14.44 | 1.93 | 9.38 | (2.2e-03) | *** | (<1.0e-02) | (0/100) | 15.78 | (2.7e-02) | 7df | (4.0e-02) | S |
| 27.9 | 16.6 | 11.3 | 13.54 | 1.94 | 9.27 | (2.3e-03) | *** | (1.00e-02) | (1/100) | 15.28 | (3.2e-02) | 7df | (5.0e-02) | S |
| 33 | 20.8 | 12.2 | 15.42 | 1.87 | 8.99 | (2.7e-03) | *** | (<1.0e-02) | (0/100) | 9.36 | (2.3e-01) | 7df | (3.0e-02) | S |
| 31.8 | 20.2 | 11.6 | 14.51 | 1.84 | 8.75 | (3.0e-03) | *** | (<1.0e-02) | (0/100) | 8.60 | (2.7e-01) | 7df | (7.0e-02) | NS |
| 31.4 | 20.2 | 11.2 | 14.11 | 1.81 | 8.00 | (4.7e-03) | ** | (<1.0e-02) | (0/100) | 8.98 | (2.5e-01) | 7df | (7.0e-02) | NS |
| 51.3 | 38.6 | 12.7 | 20.72 | 1.68 | 7.10 | (7.3e-03) | ** | (<1.0e-02) | (0/100) | 17.48 | (1.4e-02) | 7df | (1.0e-02) | S |
| 51.3 | 39.2 | 12.1 | 19.90 | 1.63 | 6.54 | (1.0e-02) | ** | (2.00e-02) | (2/100) | 12.56 | (8.2e-02) | 7df | (1.0e-02) | S |
| 50.6 | 36.9 | 11.7 | 19.13 | 1.61 | 6.37 | (1.1e-02) | ** | (1.00e-02) | (1/100) | 14.30 | (4.5e-02) | 7df | (2.0e-02) | S |
| 38.1 | 27.6 | 10.5 | 14.45 | 1.61 | 5.79 | (1.6e-02) | ** | (1.00e-02) | (1/100) | 16.77 | (1.9e-02) | 7df | (4.0e-02) | S |
| 42.5 | 32.2 | 10.3 | 15.14 | 1.55 | 5.41 | (1.9e-02) | ** | (1.00e-02) | (1/100) | 10.23 | (1.7e-01) | 7df | (4.0e-02) | S |
| 72.8 | 62.7 | 10.1 | 27.18 | 1.60 | 5.14 | (2.3e-02) | ** | (2.00e-02) | (2/100) | 8.79 | (2.7e-01) | 7df | (5.0e-02) | S |
| 39.5 | 29.6 | 9.9 | 14.09 | 1.55 | 5.00 | (2.5e-02) | ** | (1.00e-02) | (1/100) | 8.52 | (2.5e-01) | 7df | (1.9e-01) | NS |
| 42.1 | 32.2 | 9.9 | 14.65 | 1.53 | 4.87 | (2.7e-02) | ** | (1.00e-02) | (1/100) | 8.04 | (3.2e-01) | 7df | (6.0e-02) | NS |
| 42.6 | 32.6 | 10 | 14.75 | 1.53 | 4.76 | (2.8e-02) | ** | (<1.0e-02) | (0/100) | 12.96 | (7.2e-02) | 7df | (3.0e-02) | S |
| 72.7 | 62.6 | 10.1 | 26.95 | 1.59 | 4.76 | (2.8e-02) | ** | (1.00e-02) | (1/100) | 14.87 | (3.7e-02) | 7df | (1.0e-02) | S |
| 38.3 | 29.1 | 9.2 | 13.02 | 1.51 | 4.64 | (3.0e-02) | ** | (2.00e-02) | (2/100) | 6.62 | (4.6e-01) | 7df | (2.6e-01) | NS |
| 25.5 | 12.3 | 13.2 | 15.12 | 2.45 | 13.96 | (1.8e-04) | **** | (<1.0e-02) | (0/100) | 14.25 | (5.0e-01) | 15df | (1.4e-01) | NS |
| 33.3 | 19.5 | 13.8 | 17.16 | 2.08 | 11.31 | (7.3e-04) | *** | (<1.0e-02) | (0/100) | 21.26 | (1.3e-01) | 15df | (1.0e-02) | S |
| 32.1 | 19 | 13.1 | 16.15 | 2.01 | 10.96 | (9.1e-04) | *** | (<1.0e-02) | (0/100) | 18.23 | (2.5e-01) | 15df | (3.0e-02) | S |
| 23.4 | 12.2 | 11.2 | 12.74 | 2.20 | 10.89 | (9.6e-04) | *** | (1.00e-02) | (1/100) | 11.38 | (7.2e-01) | 15df | (2.5e-01) | NS |
| 31.8 | 18.9 | 12.9 | 15.89 | 2.00 | 10.26 | (1.3e-03) | *** | (<1.0e-02) | (0/100) | 16.02 | (3.8e-01) | 15df | (6.0e-01) | NS |
| 23 | 12.1 | 10.9 | 12.45 | 2.18 | 10.14 | (1.4e-03) | *** | (<1.0e-02) | (0/100) | 12.39 | (6.5e-01) | 15df | (3.1e-01) | NS |
| 33.6 | 20.8 | 12.8 | 16.19 | 1.93 | 9.66 | (1.7e-03) | *** | (<1.0e-02) | (0/100) | 18.11 | (2.5e-01) | 15df | (1.0e-02) | S |
| 33.7 | 20.8 | 12.9 | 16.28 | 1.93 | 9.57 | (1.9e-03) | *** | (<1.0e-02) | (0/100) | 21.92 | (1.1e-01) | 15df | (1.0e-02) | S |

TABLE 33

Multipoint analysis: HAPLOTYPE FREQUENCY TEST-OMNIBUS LR TEST
G40.3 UGT2B4 (4q13.3-q21)

| MARKERS | | 10-470/25 in2 | 12-652/203 bac |
|---|---|---|---|
| HAPLOTYPE 1 | | T | C |
| pvalue (1 df) | ALT+ vs ALT- (2 screening) | 4.0e − 02 | 3.2e − 02 |
| % frequency difference (sample sizes) | | 9.3(87 vs 191) | 9.5(88 vs 199) |

| | HAPLOTYPE FREQUENCY TEST | | | | | | | | | OMNIBUS LR TEST | | | |
|---|---|---|---|---|---|---|---|---|---|---|---|---|---|
| Zyflo | | | | | | | Statistical test | | | | | | |
| seconary | Estimation frequency of haplotype | | | | | | Pvalue | | | Likelihood Ratio | | | |
| effects HAPLO-TYPE 1 (ATTC) | sample sizes cases vs controls | fre-quency cases (%) | fre-quency controls (%) | fre-quency differ-ence(%) | p-ex-cess | Odds ratio | Chi-S | pvalue (1df) | (100 permu-ta-tions) | No. of permu-ta-tions | Like-lihood Ratio Test | Pvalue (# df) | | omnibus test Pvalue (100 permu-tations) |
| ALT+ vs ALT− (2 screening) | 86 vs 191 | 30.3 | 19.2 | 11.1 | 1.83 | 13.71 | 8.32 | 38e − 03 | ** 4.00e − 03 | 4/ 1000 | 7.80 | (5.3e − 02) | 3df | (5.0e − 02) S |
| ALT+(1) vs ALT−(1) | 69 vs 103 | 34.5 | 16.9 | 17.6 | 2.59 | 21.18 | 14.03 | 1.7e − 04 | ** <1.0e − 03 | 0/ 1000 | 12.22 | (6.4e − 03) | 3df | (8.0e − 03) S |
| ALT+(1) vs ALT−(2) | 69 vs 88 | 34.5 | 21.8 | 12.7 | 1.89 | 16.23 | 6.28 | 1.2e − 02 | ** 1.90e − 02 | 19/ 1000 | 7.65 | (5.3e − 02) | 3df | (8.4e − 02) NS |
| ALT vs US(2) | 277 vs 90 | 22.5 | 22.5 | 0 | 1.00 | 0.06 | 0.00 | 7.5e − 01 | 9.87e − 01 | 987/ 1000 | 1.04 | (7.8e − 01) | 3df | 7.9e − 01) NS |

S = Significant
NS = Not Significant

SEQUENCE LISTING (977 sequences)

SEQ ID NO: 1 - DNA, 1001 bp, Homo Sapiens
  allele 501: 12-421-140 : polymorphic base A or G
  misc_binding 481..500: 12-421-140.mis1, potential
  misc_binding 502..521: 12-421-140.mis2, potential complement
  primer_bind 362..380: upstream amplification primer
  primer_bind 792..812: downstream amplification primer, complement
  misc_binding 489..513: 12-421-140 potential probe
tgtctcattttgatacagatgaacctagtgtcaaatgagttggaggaagcatcctgttctactttctcagataattttaataaggttggaagagtgtgttccttcaaggttgtgtagaacttgccttaaaataatctgggcctaatgtttttctggtgggaaatttttaaattatgggatttgcattctttaatgattattggactaggcaggctttttgttacatcttgaatcaattttggtaggccttggtccttgagatgataacattggtctcttgattatccacttgctccaaggagggttttacagactactccctaggcttgaaagcgtggggtgaataccaccgggagtacacgagataattgtaagaggtgtgtagacttggttttaaataacattgaactacatgatgagaagtcattctcatttcaattatctttgaatccttatggttaagtcaagtggaaagtattggtttggagccagcatgtcccrcacctcaaaattaatgtttatttttatcaaagtaatttatgtacgtgatctgaagataaagtgggattacaggttttatgacaacaaataactcttccttgtccctacctcccctctccctctatccctagagataaccctttttgattactactttgggtatttacttctgtatttctaaacattatactttcactgctatttattgattcacaaattttagacattgtcagttggcttctttttatggaagaaataatttcatgctcctttacttcttcttttccttacctcatccttccagtaacattatatcactctgttaggttaaatcaatagccaatgtttataattattgtgattaagaaaataatgttgaaagcagggccttatagtatactgtggttacatttccttcttgtgcaattttttttccctagggttaataattgctctttatttctttgtttgcttagtttcatgcccaaatcttctgcaga

SEQ ID NO: 2 - DNA, 999 bp, Homo Sapiens
  allele 501: 12-424-192 : polymorphic base A or G
  misc_binding 481..500: 12-424-192.mis1, potential
  misc_binding 502..521: 12-424-192.mis2, potential complement
  primer_bind 310..327: upstream amplification primer
  primer_bind 751..771: downstream amplification primer, complement
  misc_binding 489..513: 12-424-192 potential probe
  misc_feature 521,541,635: n=a, g, c or t
ggatgcaatctgctggtctctagacaatgttccccttccctctggtgctactggcttccagtgctgaaactggcaactgctagttcagcaactccaaggcaggcaatgcagaaacatggcgtgggggggatggggaattcctctcttaccaaccctgcctcatttcagtttttgcttcagaagcttgggcttctcaccactttctccatctggctagctggtctactctaagccctactgtggggccactcatccagggctcacagagggccccatggtaaggccaccagctcttgattcagcttccgcacaatgtgggaacttaggacagctcaggaaacctaactcagggccttccttctccttaccatactactttactctgctatggctgtgtaaaagactgaatgggacagagatcttgtaccaggagagaaacgcccattagtaatttccaagcatgcacacatgttataggttctgagggctcaggaacagttrcatgaggtccagagttcganttatgaagctgaggaatttnactaatgtattcattcgttgaatatttcagtgtattttgcaagttggcactgtgtgagtgctacacttggctctacagtggttagcaaatctgnacacagtcctcatggatcttacataagaggaaaaaactgacaaccaaatgatcacacaaatgagtaactacacagtatgcaatgctccacaaaaggagggtcatggtgctatcttcacgagaatataagcaccacagtggttttctttattttgttcattgatgtacctagaatggggcctcacacatattaagtgctaaataagtatttgttgaatgaatgaataaataaatgcatgaaagctatgagattacttctgagaggtcagggatgaattcctgaggcagtgttattttggctgatgttaaagagaaaaaaaaattcttagttcgaattctgctagataaatttatattaaccaaac

SEQ ID NO: 3 - DNA, 993 bp, Homo Sapiens
  allele 501: 12-424-198 : polymorphic base G or T
  misc_binding 481..500: 12-424-198.mis1, potential
  misc_binding 502..521: 12-424-198.mis2, potential complement
  primer_bind 304..321: upstream amplification primer
  primer_bind 745..765: downstream amplification primer, complement
  misc_binding 489..513: 12-424-198 potential probe
  misc_feature 515,535,629: n=a, g, c or t
aatctgctggtctctagacaatgttccccttccctctggtgctactggcttccagtgctgaaactggcaactgctagttcagcaactccaaggcaggcaatgcagaaacatggcgtgggggggatggggaattcctctcttaccaaccctgcctcatttcagtttttgcttcagaagcttgggcttctcaccactttctccatctggctagctggtctactctaagccctactgtggggccactcatccagggctcacagagggccccatggtaaggccaccagctcttgattcagcttccgcacaatgtgggaacttaggacagctcaggaaacctaactcagggccttccttctccttaccatactactttactctgctatggctgtgtaaaagactgaatgggacagagatcttgtaccaggagagaaacgcccattagtaatttccaagcatgcacacatgttataggttctgagggctcaggaacagttgcatgakgtccagagttcganttatgaagctgaggaatttnactaatgtattcattcgttgaatatttcagtgtattttgcaagttggcactgtgtgagtgctacacttggctctacagtggttagcaaatctgnacacagtcctcatggatcttacataagaggaaaaaactgacaaccaaatgatcacacaaatgagtaactacacagtatgcaatgctccacaaaaggagggtcatggtgctatcttcacgagaatataagcaccacagtggttttctttattttgttcattgatgtacctagaatggggcctcacacatattaagtgctaaataagtatttgttgaatgaatgaataaataaatgcatgaaagctatgagattacttctgagaggtcagggatgaattcctgaggcagtgttattttggctgatgttaaagagaaaaaaaaattcttagttcgaattctgctagataaatttatattaaccaaac

SEQ ID NO: 4 - DNA, 1001 bp, Homo Sapiens
  allele 501: 12-425-57 : polymorphic base G or A
  misc_binding 481..500: 12-425-57.mis1, potential
  misc_binding 502..521: 12-425-57.mis2, potential complement
  primer_bind 540..557: upstream amplification primer, complement
  primer_bind 82..99: downstream amplification primer
  misc_binding 489..513: 12-425-57 potential probe
atctggtggaggtcctggtttctgagaaacaactcaagaacttatgtgaagacgttgtctttagtttctatagggaaccgaacgtcttgtaactctgtcttatttgggtgactattatttaaactattattatcttctcgcttagcgggactgaaggatagcaaggtgcttggaatttcccttgaaggaactcaagagtttttatttccgtgcttgaggtggctagcaggtccctaagagtgttccttgctctgtctccatgccagaagtttattatggggtgaaaagaggaagttaaggacaggaggcaagacctactgaaggctcaaaaactgacagaggaggaagtatggatgtggaagtgaaagaagtccacagagctcatcacaagatgaaggtggtcccaggcatcagagttgattatctaatgaaataaaggagaagaaagtcatactgttttataacagggaaacgtcggcaggtaggagccatcatccccaragttttcttgtacctgctgggcaaggtgtcagagccctggcaatggaaagtgattggcccacagggagtaagaatttaccgacaacaatataggtttgaaaaggaaagttttattagattgagagaaagctgcagaagagtgcagcgggctgcctcagcgagaggactgagcgcgccggggaggattttccttaggggtatttatggaccttaaagcaagagcttaggggtaatttggtccatattagccacatatgtcatgataaatgattacatttgtagacattttggtgtcgtaatgtcagcaagggttgcacaatgagttttgtcatgcatgcattccggagatgtatagaggtagagaaagtctagttacatataaattttggggaaagaagcctggaaccggccttagatatagggaagatcaattatttctaaactcctcagataaggagttctgcctctggatggtcggcttcatggccaccaggtggtct

SEQ ID NO: 5 - DNA, 961 bp, Homo Sapiens
  allele 461: 12-426-154 : polymorphic base A or G
  misc_binding 441..460: 12-426-154.mis1, potential
  misc_binding 462..481: 12-426-154.mis2, potential complement
  primer_bind 308..325: upstream amplification primer
  primer_bind 830..847: downstream amplification primer, complement
  misc_binding 449..473: 12-426-154 potential probe
  misc_feature 705,761..762: n=a, g, c or t
tccctagctagcaaaatcagtgactcctgggaacttgtaaaaaatgcagattctcaagccccgcttcagatttactgaatcagaaacactgtgtatgttttaacaagctctgctggtgctttcagtgcaggctaaagtttgagaactacagatacaaaggagggctctgtatctgcaacaacaactatgtaatgatgactagtccccactcttctgaagctacccatggcaaaattagaaacataattcttcaaaaaccactggcactgatttagtgcacagaacacctgtggataactcaattccttttgtccttccctgtgtcaaggccaaaggatctaatgtgatataagcattccagaggtggaagggagtggtagctactcaagacccagtatttttacaggtgatcttcaatgtgatctgtcagtaaatatcaatggctttcagactgtaaactrcagctcacagttcatgatctaggatatatacatgtgggtttaaaacagaaagaaaagtttctgatatgctctggtaatttctgttgtatttcattttaaaaatgttggttgtgacccactaagttgtttccaataaccttgtgtgttgcaatctgagaagttaaaaatgctaccttagatcagaaaattttcacccagtctattgataaagttcagggatacttgtgaaattatataaaagttntgtatatatttacatattatatgtttctctgcaagaggcttcatagctttttgcannacacttaaaggaataggtaacttttgagaagctaggacacattgatctagatcccacaaaatgggcagaggatgggattaggatttctgctgctaggtgacccctgtagccccctgaaaactcctgtggataagattaggaaggctcctcaggctattttcttcaccccatataagaccctcaagggtctttttttttt

SEQ ID NO: 6 - DNA, 1001 bp, Homo Sapiens
  allele 501: 12-429-198 : polymorphic base C or T
  misc_binding 481..500: 12-429-198.mis1, potential
  misc_binding 502..521: 12-429-198.mis2, potential complement
  primer_bind 304..321: upstream amplification primer
  primer_bind 803..823: downstream amplification primer, complement
  misc_binding 489..513: 12-429-198 potential probe
  misc_feature 44,561..562,954: n=a, g, c or t
ggtcaggagttcaagaccagcctggccaatatggtgaaaccccngtccgtactaaaaataaaaaaattagctgggcgtggtggcaggcacctgtagtctcagctactcaggaggctgaggcaggagaatcgcttgaacccaggaggcggaggttgcagtgagttgacagtgtaccactgcactccagcatgggcgacagaccaagattctgtcttaaaaaacaaaacaaaacaaaacaaaaaactgggaggggaaaatatttttttattttctaatatgttagaaccctttctcaatgtgtaactctcctcattcttctccctctcatctttaaccaaaattgtaaatgttctacatgtgcatcatgttagtctatcaggtgttatttagataattggtgcctttgacttacattcttgtaaacgttgctttagttcataaactcataatattcccagacctgaagcctgtcttaaaattgataatgtaaatcatctaggyctgaatgcctaaagtgatggggagctcaccacctcttgtttctggtcataggtaggtganngatcccttctgcagcaagaagtcaggggcaggcctgtgacactagctctgattcctgcaaatgaccaaatgaggggcagggcctggtggtctcccagtcccagctgaggctcccatgacctgcaccctcctgccctcccaactctcaggttctcccaacagccctcccccagctaatttcataaaaggcactaaaaacttttgatcagtcacaaaatcatgggaagagaaagaaatacaagaagagagaaagaagggaaagtggcgtgaatcattaacaaaggcaccacatccctgatactgtactgttctgggtgcttttttctcaatgaattctcacaaaatcctgttggtattagtgattcatatttcttacatatagaaactgagtcngcaaagaggttattacttaacttgcccaagatcgtacagctaataag

SEQ ID NO: 7 - DNA, 996 bp, Homo Sapiens
  allele 501: 12-430-80 : polymorphic base T or C
  misc_binding 502..521: 12-430-80.mis1, potential complement
  misc_binding 482..500: 12-430-80.mis2
  primer_bind 561..580: upstream amplification primer, complement
  primer_bind 131..150: downstream amplification primer
  misc_binding 489..513: 12-430-80 potential probe
  misc_feature 918,971,978: n=a, g, c or t
gaatgccctaattctctggagctgtgtcctgaggcattaaggggtaaagtggttggatgtactttaaaatggttctgcgaaatatatatgtgaagcatttatggcaaagtgttaatgattacatctaattggtaagtgtataggtattcgttgtattattatttctactttcctggttgtttaaaaatgtttataataaagagttaaaggatctgaagagaagttaaaacctaaaatcagattcttggtagccctgaagattttctgtgttgagcattgttaagagatccagtggtattgatggatccacagtcatccatgctggcctggcagctgtcctgggtgtggcacagatgcctgggccccacatgtgtgagagctgcagtaattacctccacctgttgcatgaaatgaggcaggtgtctgtgccagctactccagaggacactagtggaggaatttaatgtccttagtacttaaaagagaattgaggacaaaatyggatttacaaaaagaggaaacaaatcaaaaagaaaattaaaaggtaaagactggttacccaaagaggtagctctgttccattttcagataatttttcttgttccacttttcttttaggggttggaggtgggtggggtatggccaaaaaagtcattaataaacaaaatcaggtcatttgaggttcaccctttttctccagacacaatcttccttgaaaagaatggtcagaggcagaaacagctcattgaatgctatggaatgttccttaatcaccagtgaaatacgtctttctcactgggggcagatgtctagtgactttctagaaaaatgtttattctctcctctttcttcccccatcaccatacttactgcactaggattttataaaggtcagtaagattacatgtaagaactcantttgaaaagagaaaggtattccattcatccagtgccaaacgagtataagtaangaatatngtggcttgaattgattgg

SEQ ID NO: 8 - DNA, 1001 bp, Homo Sapiens
  allele 501: 12-433-215 : polymorphic base A or G
  misc_binding 481..500: 12-433-215.mis1, potential
  misc_binding 502..521: 12-433-215.mis2, potential complement
  primer_bind 287..304: upstream amplification primer
  primer_bind 805..825: downstream amplification primer, complement
  misc_binding 489..513: 12-433-215 potential probe
  misc_feature 92,202: n=a, g, c or t
cagctacccgaagggcaccatgtgagcccacgtgtaagggctctgggtgacagctccagctatggccccagcacgcagccccacctgcatgngatatacgttcatatgattctagcccacagctgtgggggcactcccagccattgtctcctcagctgaggcctcagacattgaagagcagagacatgccagtcctaccgtngccctactgacccacataactcattagagcctaattaaatggttgttataaacccctaaactttggggtactttgtcacacctgagtagtcaccagaacaacctcattgcaaggtaacaactcagcttcccagggttcatcatttggctccagtgataccaccccatgccctgcaagtgtggcacttcagacaggagccagggacaccaggagtatggctggtggcccttaggtggcaggattgcagaggccccaccggaagtcagctggccacagcagagccaaggtagagtgcatgrttgaaaattcaggagacaggatgagctccagaaaattgggcgctgcactggacgtgcctgataaagcaaagagggagagaaaagaggagttaaggatttccacatttctggtttctgaacagctagatacattaatgatggggcaatttactgccacagaatttagaccaaaggagggggctaggtttgaagtgcctgtgagtccattagaaatgacaagaagtgggagcccaggtcaccaaagatggtcaaggtcattgatcttgagaccacagggccccaagaaggcttaagggtctgtccctgattcttgtttcctgtgtgagaaatattttgcaggtgtcaggctgggactcttgaccagctgaattacgtatttccagaacagggtgttaaagaagacagaagcgaccccaggaaaaagcgtggcttccacaagagctgccatatacaaacaagcatgccccacaacgctggcaggagagatatcatcagattta

SEQ ID NO: 9 - DNA, 1001 bp, Homo Sapiens
  allele 501: 12-441-233 : polymorphic base G or A
  misc_binding 502..521: 12-441-233.mis1, potential complement
  misc_binding 482..500: 12-441-233.mis2
  primer_bind 716..734: upstream amplification primer, complement
  primer_bind 284..303: downstream amplification primer
  misc_binding 489..513: 12-441-233 potential probe
  misc_feature 661,929,990: n=a, g, c or t
gaagaacttagacaatgcctgaaatgcaaaggcgacactggagtcttctttctctaacgtgtagcgttgaatgaatatctgcctggaaccaagagggctgctctgatgtttgggagtcggttttttgtgagccacatctgatatttctgatatccccaggaaggagtggcctggaggtcactggttcaggctccctttgggcgaaatcctgggagtgatgctctaaaaatccacctttcccatcatccctactcatcagaaagacaaatataaaatcccagagaggtggaggagctaaaaaagcaattgctccaccttacaaatttggatagaaaggagatgtagtttatttcatatgggcaaagtagtcctcttccaaagtcctgtacaattgttctctgcaattgacgcacatctgccctaagcgaaatctgtcagaaggaatcaacaaggctccttgcctcccctcccaatcccccttttggaggacttgtggcttcrgtgtcgtcctaagtgagagtggcgtgtgcttttttcctgtcccctcctccctccgtgtcctagacgctggctgccttctgtgcactcccaggcagatcactacggaagagtcggagcctgtggggttggactggccacactcagtcctgagaaggcgagnttgccatggaaagctgggggcagaggtgtttttggagaggaggcggcaggcaaacattgcctttgacttgctctccgcgtacccggggttgtagagctgctcaggaaggggcaggatgtaaggccagaggtgcctggtgggtgagaagcccaggcaggggctgggcgccctctccgaagaggtggcagcagggtgaccctgaactccccaaatggggagtgatgccactggggaaactgagtggatcaaagagatgaaaccaaaaaanaagcaaacaaacaaatgagaagacacaaaacataattaccttttcctgaaaggtacagganaataaatatat

SEQ ID NO: 10 - DNA, 1001 bp, Homo Sapiens
  allele 501: 12-441-343 : polymorphic base G or A
  misc_binding 481..500: 12-441-343.mis1, potential
  misc_binding 502..521: 12-441-343.mis2, potential complement
  primer_bind 826..844: upstream amplification primer, complement
  primer_bind 394..413: downstream amplification primer
  misc_binding 489..513: 12-441-343 potential probe
  misc_feature 3,771: n=a, g, c or t
tanttcctccttgcctccacaccagcctccccttgcttctccttacagactatccaagaagtgaagcttatgtctttagggagccttgggcagagtccacataaatgcaggaagaacttagacaatgcctgaaatgcaaaggcgacactggagtcttctttctctaacgtgtagcgttgaatgaatatctgcctggaaccaagagggctgctctgatgtttgggagtcggttttttgtgagccacatctgatatttctgatatccccaggaaggagtggcctggaggtcactggttcaggctccctttgggcgaaatcctgggagtgatgctctaaaaatccacctttcccatcatccctactcatcagaaagacaaatataaaatcccagagaggtggaggagctaaaaaagcaattgctccaccttacaaatttggatagaaaggagatgtagtttatttcatatgggcaaagtagtcctcttccaaagtcctgtacarttgttctctgcaattgacgcacatctgccctaagcgaaatctgtcagaaggaatcaacaaggctccttgcctcccctcccaatcccccttttggaggacttgtggcttcagtgtcgtcctaagtgagagtggcgtgtgcttttttcctgtcccctcctccctccgtgtcctagacgctggctgccttctgtgcactcccaggcagatcactacggaagagtcggagcctgtggggttggactggccacactcagtcctgagaaggcgagnttgccatggaaagctgggggcagaggtgtttttggagaggaggcggcaggcaaacattgcctttgacttgctctccgcgtacccggggttgtagagctgctcaggaaggggcaggatgtaaggccagaggtgcctggtgggtgagaagcccaggcaggggctgggcgccctctccgaagaggtggcagcagggtgaccctgaactccccaaatggggagtgatgccactg

SEQ ID NO: 11 - DNA, 1001 bp, Homo Sapiens
  allele 501: 12-442-221 : polymorphic base T or C
  misc_binding 481..500: 12-442-221.mis1, potential
  misc_binding 502..521: 12-442-221.mis2, potential complement
  primer_bind 704..721: upstream amplification primer, complement
  primer_bind 270..289: downstream amplification primer
  misc_binding 489..513: 12-442-221 potential probe
  misc_feature 180,531..532,822: n=a, g, c or t
attctaagcccatgttttatcctaaagtacccctttacacagaaaaacgaattcatggcacaaaatacaccagcttaagactagccttagaattctttttggcattaatcaaaactttacagaggacataaacactgattttttccccccattcatttaactatttgcacacagagacangaagccagaaatctgactgggaagaaattcctacccttttgccagcatgctaagcttctgggttctctttccctgagtggccctagtgatctggcttgtggcacaactgcctttgggggccaagccgcatcataaaggaaaagtatttctttttgttctggccaaagcaaaatacgcgtaataaaacatagatattaaccaggctgcttagcatccaatatcaaactggcaaggcttaaatttgccctcaggtgggccctgtcatctttaatctaacctccgactaggagtttcaacatgtggtctctgggcaagatggtygccctgagtaatagaaaagaaagagaaagnngagagagagaaaaacattgcctgtggcagggcggggaaggtgaaatgatcagggaggcagagaaagaaccacccattgcagcgacactaaaaagttcaggtggctgctgtcggtggagcaaggatcttttccagtaatcctaccagctctcaaatttcccttgttagggaggaaaaagctccccatgtcccaggatcctgtacattcctaattctgtcacccatagccatcagcaaagtacaagggagattaatccaaagagaatagcagttaacatcccatagtgccgnaacctgttcttagccgagagggactttaccgaagaggggcctctaacccgctaaatcttagaagggactctaactctcctaagtcgggcctctaaccagaggtcagtcaagcatccttgccttttattaagggggagcctttaaccacctctatcttaggagagactctaactccacta

SEQ ID NO: 12 - DNA, 1001 bp, Homo Sapiens
  allele 501: 12-447-58 : polymorphic base G or C
  misc_binding 482..500: 12-447-58.mis1
  misc_binding 502..521: 12-447-58.mis2, potential complement
  primer_bind 444..462: upstream amplification primer
  primer_bind 874..893: downstream amplification primer, complement
  misc_binding 489..513: 12-447-58 potential probe
  misc_feature 44,894: n=a, g, c or t
tgggctgtagttttctgactcctgatctatgtaatctccaattngcgcaacatcagtttgtctctctctctctctttttttttttttttttcagacagggtctcactctgtggcccaggctggagtgcagtggcatgatcttagcttattgcagctttgatctcccaggctcaaacgatcctcctgcctcagcctcctgagtagctgggactacaggtgggtgccactgggcccagatagttttttattttttgtagagatagagttttgccatgttgcctaggctggtttcaaactcctggactcaagttatctgcccaccttggcctcccaaggtgctgggattacaaacgttagccactgcccccagctgtctccattttttaaattaaaatacataatgttctagtaaatattcttgtgggcaattcattggacctgtcttagattacatgcccagagtaaattctagaaatgaaattcctggtcttctccgaagasggaattgagtggggaaaaaaaagaaaatgaaaaaagaaataaacacaagatattcttggtcaaattgtgtctgccctttctcctccagtgagctacgatgaagccacagtaatccacattcccaggggaacacaggtggtctgcctctccatgtgctcagagtgccaattcttggtaaggagatatagggactggagtgaaacattggaataatgactcatattcatgttttataaacaaatttaaaatattggatcaggttatttatctggaaaccctgaagtttggctgtttaaagggctattttaaatataggcaacagaaaacaaaatacaaagtcttatttctgacactttaaaatgttggcaaagtgtcttccttgttagtatggtnggtgagtatccccacctgtcataaaatggcaaataggctgggtgcagtggctcatgcctgtaatcccagcactttgggaggtcaagttgggaggatcatttgagtcc

SEQ ID NO: 13 - DNA, 1001 bp, Homo Sapiens
  allele 501: 12-453-429 : polymorphic base C or T
  misc_binding 481..500: 12-453-429.mis1, potential
  misc_binding 502..520: 12-453-429.mis2, complement
  primer_bind 73..91: upstream amplification primer
  primer_bind 577..596: downstream amplification primer, complement
  misc_binding 489..513: 12-453-429 potential probe
aatcatgatttacccctggatgggaatcagggtcaccttcaaagagcatatggacatgtgaaggagcataaacacaatcacaaaattggggctcccaccatcggttgcagaggcagtcggcagtgtctgctacaagtgacatcaagtagcatctatcaagtggcattactttaacaaatattaacaatagggtcctcatctcagtttagaagaaaaatccaaaatcaaagtagactgaagataaggtaaacggtgatgtttgccacactagtggtgaggttttcatagttttacccaaaccagtttttatttttagtgcttggttggggtcactgaaacttccaggttgtcctaacctgttaaaatcttttaaaacattatttgtgactgtttctctttggacagtgctttttgttaatcacaaaaaacagggtagaaggtaataacacatgcaaagggatgtgtagcaatcaaagggaaatgttatccttcctaggagayaggatttatgggattcctggatcttttttgtgtctgattgttaaggtcttgacagcctttcaattgaggaatacggtcgtgtctgttaaactaattgtagctgttcactccactatataattttacaacatttcagcttcaaatagaatggcttcaataaacataaagcagactgacacatcccagatttctgcagtttattttacaccaagaaattacatttagagatttccagacacatactataaatgaaaattcaacaggaagtttctttcatttcctctagatctgacctatatttcaaaaatatatgagtgggctataaccaggaacttcttctcttgctcccattattcacaccgttttctgaagagtttttttctcgtccgcgactctaatggccattaagggaattgcagacattggaagactatacaaccctaagtgaaatgagtgaaatgataaatgttatccacaagatggccaaattgtatggttct

SEQ ID NO: 14 - DNA, 929 bp, Homo Sapiens
  allele 501: 12-454-363 : polymorphic base A or G
  misc_binding 481..500: 12-454-363.mis1, potential
  misc_binding 502..521: 12-454-363.mis2, potential complement
  primer_bind 139..158: upstream amplification primer
  primer_bind 634..652: downstream amplification primer, complement
  misc_binding 489..513: 12-454-363 potential probe
  misc_feature 674..679,881..882,892..893: n=a, g, c or t
atcccagatgattactaatttaaaactactttacattttatttagtaatgtgtttggaacagttacattttgtagctacttacaattttactttaactgaaataataagacaaggccataaatattggcctccctggctggggagttgtgtgggtttcctttccaggcagttgaggttttccatggagcctactctacagtgtcagcaggagtataacatagaaggcttccaggtcaggtggcccagagtcaaatcaaagccccatccctttttagcaaatttctcagccttacttagctgtgccggcctgcctctttctaaaatgaggaaaataataatacccacttcactggtttattgagaggattaaatgaggacatgtgttatttcacaccattattgcttctgttgttattattttaaaatctaggttggtgattgcatcagtttcttagggctgctctaaagaaagtaccacaagctgagtgacttacatagcrgaaaagtgttttcttacaggttaagaggctggaagtctgaaatcaaggtgtcagcagggccatgctcccactgaaacccatagcggggaatcctttcttgcttctaagtttctagtgtttccttggcttgtagatgtgtcacttcagtcacacggccatcttcttctttcttnnnnnncttcttcttcttcttcttcttcttcttcttcttcttcttcttcttcttcttcttcttccttcttcttcttcttcttcttcttcttcttcttcttcttcttcttcttcttcttcttcttcttcttcttcttcttcttcttcttcttcttcttcttcttcttcttcttcttcttcttcttcttcttcttcttctttgagatggnntcgctgctgnngctcaggctggagtgcaatggcgtgatcttggctca

SEQ ID NO: 15 - DNA, 827 bp, Homo Sapiens
  allele 501: 12-455-326 : polymorphic base T or C
  misc_binding 502..520: 12-455-326.mis1, complement
  misc_binding 481..500: 12-455-326.mis2, potential
  primer_bind 808..826: upstream amplification primer, complement
  primer_bind 372..392: downstream amplification primer
  misc_binding 489..513: 12-455-326 potential probe
  misc_feature 798..799: n=a, g, c or t
ttcataagccgtaatatttctagcttgaagaaaaaaataataattcagagaactctgtttcttagaggaaattgacaggaagaggaattgagaagaattctatagaatgggtaatgaacaatggatcaggaacaatagcagaataataaggcctgcagaactacctggaaacctgaactctgggtcacacacagggtgcaaacttaagaaaactccccacagcttttaaaacagctcaggaaatctgtgagttaaaggaaagcctaacacaaatacagctttaccttaagcatctttgtccaccctcgccctataattcctcagctttgagagaaagccttccctgcagactgctactgtagatttcaatttgttttgtttttagagatgcccatacctgacttagcattatcctagggaaaggcctgaggctgtccacaagagatccccaggcggcttctgtgagggtctgcacagagaatcttgcacagcaggctcttycttataggaggtgtgaggttgtcatataaagctgaaggcccaacataagtctgcctcacagttatccttctagaatattcctgatagggtcagaattttatgaattttttcttaaagaaatagagacggggtcgcactatgttgaccaggctggtctcgaacttctggcctcaagcgatcctcccatctcagcctcccaaagtgctaggattacagatgtgagccaccacgccctgccagaattttgcaaatttactaagcatccaccaccgtgtatcctgtgtaggacacgggccnngggaggtccctattaaccaagatagcag

SEQ ID NO: 16 - DNA, 884 bp, Homo Sapiens
  allele 501: 12-455-383 : polymorphic base G or A
  misc_binding 481..500: 12-455-383.mis1, potential
  misc_binding 502..521: 12-455-383.mis2, potential complement
  primer_bind 865..883: upstream amplification primer, complement
  primer_bind 429..449: downstream amplification primer
  misc_binding 489..513: 12-455-383 potential probe
  misc_feature 855..856: n=a, g, c or t
tgatttctggtacaggggtctgtgtaatcagcacatggcggggactgtctcacatgcttcataagccgtaatatttctagcttgaagaaaaaaataataattcagagaactctgtttcttagaggaaattgacaggaagaggaattgagaagaattctatagaatgggtaatgaacaatggatcaggaacaatagcagaataataaggcctgcagaactacctggaaacctgaactctgggtcacacacagggtgcaaacttaagaaaactccccacagcttttaaaacagctcaggaaatctgtgagttaaaggaaagcctaacacaaatacagctttaccttaagcatctttgtccaccctcgccctataattcctcagctttgagagaaagccttccctgcagactgctactgtagatttcaatttgttttgtttttagagatgcccatacctgacttagcattatcctagggaaaggcctgaggctgtccacaagaratccccaggcggcttctgtgagggtctgcacagagaatcttgcacagcaggctctttcttataggaggtgtgaggttgtcatataaagctgaaggcccaacataagtctgcctcacagttatccttctagaatattcctgatagggtcagaattttatgaattttttcttaaagaaatagagacggggtcgcactatgttgaccaggctggtctcgaacttctggcctcaagcgatcctcccatctcagcctcccaaagtgctaggattacagatgtgagccaccacgccctgccagaattttgcaaatttactaagcatccaccaccgtgtatcctgtgtaggacacgggccnngggaggtccctattaaccaagatagcag

SEQ ID NO: 17 - DNA, 1001 bp, Homo Sapiens
  allele 501: 12-456-269 : polymorphic base A or G
  misc_binding 481..500: 12-456-269.mis1, potential
  misc_binding 502..521: 12-456-269.mis2, potential complement
  primer_bind 233..252: upstream amplification primer
  primer_bind 693..712: downstream amplification primer, complement
  misc_binding 489..513: 12-456-269 potential probe
  misc_feature 20,447: n=a, g, c or t
cattttcatagcttttttantttattaaatatcaccattgggttgactcagtagcatctcatatacctacctgatgggctgcagcagatattggcactcagacaagccaattttaggcatcagagccctgtagccgtggtaacctcacccctgtgctggacgggaggcaggtcggctaagcagaggtgctggaagtgtgtgtggtaccaggactgggccgcaggagctgcacagcctcacagcacattagccaatggccccatgccaacccccttggctgggttttctggaacaggtacctccttaccattccaagaaaaagtctcctcctgccccccaaaagtggggggcaggtgatccaaaagatcactaagcaaatgcctgtttgtcctttggaatactcaaccctgatcagtggtgaatactcagtcaccaactatgtggaangaggcacaaccatggcagacaacagatatggaaagagcaggaattcttctagcrggaattcttatatcaaatgcaatggtggccatgcccccaacagctctgcagttggaaaaatgaagccttcaagtaaggccaaagtcctactgtttgagggcaattcatctgggccaaatccctcaggagcagggccatgcgggggttacaactgttcatgcaacacaacagattgggcttaagctggccagggcagtgacgggcttttcatcttaattgtagttgtctgtgtcccaagaaaatgttatcagcttttcagaaaaactttcaagagactcgagcaagtcaaacccaagctgccctccttgtctgcatatcctgctctgttttcccatttgggaaatgaaaccagcagcagctgagagggagaaggttctacactcactggttttctccactcctaccactccctccttccccctcctctctgtcaccctgaagaaatctccttctggaataaggtgtcattcatccttgtcacctccagtatagttatgtca

SEQ ID NO: 18 - DNA, 1001 bp, Homo Sapiens
  allele 501: 12-456-380 : polymorphic base G or T
  misc_binding 481..500: 12-456-380.mis1, potential
  misc_binding 502..521: 12-456-380.mis2, potential complement
  primer_bind 122..141: upstream amplification primer
  primer_bind 582..601: downstream amplification primer, complement
  misc_binding 489..513: 12-456-380 potential probe
  misc_feature 336: n=a, g, c or t
tttaggcatcagagccctgtagccgtggtaacctcacccctgtgctggacgggaggcaggtcggctaagcagaggtgctggaagtgtgtgtggtaccaggactgggccgcaggagctgcacagcctcacagcacattagccaatggccccatgccaacccccttggctgggttttctggaacaggtacctccttaccattccaagaaaaagtctcctcctgccccccaaaagtggggggcaggtgatccaaaagatcactaagcaaatgcctgtttgtcctttggaatactcaaccctgatcagtggtgaatactcagtcaccaactatgtggaangaggcacaaccatggcagacaacagatatggaaagagcaggaattcttctagcaggaattcttatatcaaatgcaatggtggccatgcccccaacagctctgcagttggaaaaatgaagccttcaagtaaggccaaagtcctactgtttgagggcaattcatctkggccaaatccctcaggagcagggccatgcgggggttacaactgttcatgcaacacaacagattgggcttaagctggccagggcagtgacgggcttttcatcttaattgtagttgtctgtgtcccaagaaaatgttatcagcttttcagaaaaactttcaagagactcgagcaagtcaaacccaagctgccctccttgtctgcatatcctgctctgttttcccatttgggaaatgaaaccagcagcagctgagagggagaaggttctacactcactggttttctccactcctaccactccctccttccccctcctctctgtcaccctgaagaaatctccttctggaataaggtgtcattcatccttgtcacctccagtatagttatgtcagatgcagtgaggtgctggatttagattacaagaagcgggaggattcttgcaaagagaggacaacatttgcttaactatgccaagggtccccttgtcccccgaccaagaggg

SEQ ID NO: 19 - DNA, 1001 bp, Homo Sapiens
  allele 501: 12-457-204 : polymorphic base A or G
  misc_binding 481..500: 12-457-204.mis1, potential
  misc_binding 502..521: 12-457-204.mis2, potential complement
  primer_bind 298..317: upstream amplification primer
  primer_bind 772..792: downstream amplification primer, complement
  misc_binding 489..513: 12-457-204 potential probe
ttgagggcaattcatctgggccaaatccctcaggagcagggccatgcgggggttacaactgttcatgcaacacaacagattgggcttaagctggccagggcagtgacgggcttttcatcttaattgtagttgtctgtgtcccaagaaaatgttatcagcttttcagaaaaactttcaagagactcgagcaagtcaaacccaagctgccctccttgtctgcatatcctgctctgttttcccatttgggaaatgaaaccagcagcagctgagagggagaaggttctacactcactggttttctccactcctaccactccctccttccccctcctctctgtcaccctgaagaaatctccttctggaataaggtgtcattcatccttgtcacctccagtatagttatgtcagatgcagtgaggtgctggatttagattacaagaagcgggaggattcttgcaaagagaggacaacatttgcttaactatgccaagggtccccttrtcccccgaccaagagggccttcatgctccctcagcttgactgaactttaggcaggattcttcctaacctcccttttttttttagagcatttcttgtcattgtacattttttctctgcccctttgagatgtatgtaaatctcttcaaaagcctcctgccagttttacaatccaggaatgtctttctcaaggacctgggagccctccctttgaaatgtaatcatcaaaggagatggcacccctgtctcccagtctttgtggagagtttttgtgggagtctaacttcagcaggacaccttcctccaagtcataaaaccatcccttgtcaaaagatagaagtttattagcaaacacaaatggcctacgacctcttcacaacatcctctggcatgtttcactagcctttaaaagcctttaaaaactttgcaccctctgcatcagcagcattgagttcacactgagttctagtccctctctcctgttgcaataacttcggataaac

SEQ ID NO: 20 - DNA, 1001 bp, Homo Sapiens
  allele 501: 12-457-206 : polymorphic base C or T
  misc_binding 481..500: 12-457-206.mis1, potential
  misc_binding 502..521: 12-457-206.mis2, potential complement
  primer_bind 296..315: upstream amplification primer
  primer_bind 770..790: downstream amplification primer, complement
  misc_binding 489..513: 12-457-206 potential probe
gagggcaattcatctgggccaaatccctcaggagcagggccatgcgggggttacaactgttcatgcaacacaacagattgggcttaagctggccagggcagtgacgggcttttcatcttaattgtagttgtctgtgtcccaagaaaatgttatcagcttttcagaaaaactttcaagagactcgagcaagtcaaacccaagctgccctccttgtctgcatatcctgctctgttttcccatttgggaaatgaaaccagcagcagctgagagggagaaggttctacactcactggttttctccactcctaccactccctccttccccctcctctctgtcaccctgaagaaatctccttctggaataaggtgtcattcatccttgtcacctccagtatagttatgtcagatgcagtgaggtgctggatttagattacaagaagcgggaggattcttgcaaagagaggacaacatttgcttaactatgccaagggtccccttgtyccccgaccaagagggccttcatgctccctcagcttgactgaactttaggcaggattcttcctaacctcccttttttttttagagcatttcttgtcattgtacattttttctctgcccctttgagatgtatgtaaatctcttcaaaagcctcctgccagttttacaatccaggaatgtctttctcaaggacctgggagccctccctttgaaatgtaatcatcaaaggagatggcacccctgtctcccagtctttgtggagagtttttgtgggagtctaacttcagcaggacaccttcctccaagtcataaaaccatcccttgtcaaaagatagaagtttattagcaaacacaaatggcctacgacctcttcacaacatcctctggcatgtttcactagcctttaaaagcctttaaaaactttgcaccctctgcatcagcagcattgagttcacactgagttctagtccctctctcctgttgcaataacttcggataaactt

SEQ ID NO: 21 - DNA, 1001 bp, Homo Sapiens
  allele 501: 12-458-196 : polymorphic base T or A
  misc_binding 481..500: 12-458-196.mis1, potential
  misc_binding 502..521: 12-458-196.mis2, potential complement
  primer_bind 679..696: upstream amplification primer, complement
  primer_bind 200..217: downstream amplification primer
  misc_binding 489..513: 12-458-196 potential probe
  misc_feature 33,792: n=a, g, c or t
ctgctgcaaccactacaagacaggaagaagggnaagggaagggaagctgagtgctcagggcatgctgtggagggaaggcgagggcacttcccgccgtcatctccagaaccgccacagccttgggaggggggctgagagagatcagtgctgactgcctgagaagaggccttccacaagctgcctttctggtgtccccatgttcttccttccttccttccagaggccgtgagagggagggcccgtgtcagcctgctctgccggtttcccgactgctgaacctgtctgtgggaagctgggtttgactatgtgatgctgaggctctgagaggagggctacccttttccccaccctcggcccccattcctatgagtagaagcctgcccagctgcggtggtggggtttgaggaggctaggacttagagcagggaaaaacaaggaagcagaatgaaaaacagaaacacttagaaatctgggattggtacttctccttatgtaaagatwgtggctgacgaccagcttcttagaggaagcaagtctaggagaagggctcatacctggtccgtgagggcctatgggggatcagggcataagaccacctgaccctgggccttgcatccacaagaaccttgagtttagatttttagacatattctttgaacaaggttttacatatatagtcactgagaaatcctgagaggattgaaaaatagcatctattttacagctttaaattgtgccctgagctgagcgtggtggctcatgcctgtaatcccagcactttgggaggctganggtgggaggattgcttgagttcagttcaggaccagcctgggcaacagcaagacctcatctctactaaaaataaaaaaattagctgggcatggtggtgtgcacctgtagtcccaattactcaggaggctgaggtgggaggattgcttgagcctgggaggttgaggctgcagtgagctgtgattgtgccactgcactccagcttgggtgac

SEQ ID NO: 22 - DNA, 1001 bp, Homo Sapiens
  allele 501: 12-458-438 : polymorphic base T or C
  misc_binding 481..500: 12-458-438.mis1, potential
  misc_binding 502..521: 12-458-438.mis2, potential complement
  primer_bind 921..938: upstream amplification primer, complement
  primer_bind 442..459: downstream amplification primer
  misc_binding 489..513: 12-458-438 potential probe
  misc_feature 275: n=a, g, c or t
aaaatagggagggggagcagtctcagctgtcttcagctgctagggagatttttttccccctcctgagctactgtttcccccaacccgagcctttctctcttattgtacccaccctttctgatgaagtcatcaaagcaaagattgcataactgatgcataggcctatcttgtgttatactgggagacaggccaatgtttccattaatagacaagagcaccaccacgctgccaaatggagctctctgctgcaaccactacaagacaggaagaagggnaagggaagggaagctgagtgctcagggcatgctgtggagggaaggcgagggcacttcccgccgtcatctccagaaccgccacagccttgggaggggggctgagagagatcagtgctgactgcctgagaagaggccttccacaagctgcctttctggtgtccccatgttcttccttccttccttccagaggccgtgagagggagggcccgtgtcagcctgctctgcyggtttcccgactgctgaacctgtctgtgggaagctgggtttgactatgtgatgctgaggctctgagaggagggctacccttttccccaccctcggcccccattcctatgagtagaagcctgcccagctgcggtggtggggtttgaggaggctaggacttagagcagggaaaaacaaggaagcagaatgaaaaacagaaacacttagaaatctgggattggtacttctccttatgtaaagattgtggctgacgaccagcttcttagaggaagcaagtctaggagaagggctcatacctggtccgtgagggcctatgggggatcagggcataagaccacctgaccctgggccttgcatccacaagaaccttgagtttagatttttagacatattctttgaacaaggttttacatatatagtcactgagaaatcctgagaggattgaaaaatagcatctattttacagctttaaattgtgccctgagctgagcgtggtggctc

SEQ ID NO: 23 - DNA, 1001 bp, Homo Sapiens
  allele 501: 12-460-274 : polymorphic base A or G
  misc_binding 481..500: 12-460-274.mis1, potential
  misc_binding 502..521: 12-460-274.mis2, potential complement
  primer_bind 228..245: upstream amplification primer
  primer_bind 760..777: downstream amplification primer, complement
  misc_binding 489..513: 12-460-274 potential probe
  misc_feature 873: n=a, g, c or t
gacataattgccctctgcctccttaggaaaacaccagacctctgagaaggaggtgattaaaccgttcagtcacttgacaaagataatctaattaattaatgaaaggatttaacacccatgtctggagcatttgcaatgtgctagacacccttctgcatatgccgtgacagctctgacatgacaaacaaggcctgtggagaaacgcagactaggtaacagaataaacaagaatgtgtaaggtggtgacaaatgctatgatgaaaattaacaaagggaagtattaaaccagagaagtattcaatagaagtgtggctgggtagctacccttggttgggtggccagggaagacatctttgaggaagtgacttttatgctgagaccaaaaaccagctaagagaagataaggggaggggaatcccaggtaaggaggaactgtgaatgcaaaggtcccgaggtaggacagaacaaaatgcaaaggccctgaggtaggatagaacaaarcagtctcggcctcccaaagtgctaggattacaggcatgagccaccactcctggctacactggaaggctttaagcagggcaaagccttatgtgatctgacttgaaaggccactctcctacccatgaagaacaggcaagagtagaggcagaagcacaaatgaattagatgacagcagggatgctggtggccactatgtagtgtacactcaaccgtgtgcctggagctccttaaagccctttatctgcattatccattaatccacacaacctctctatagagtaatttctagaatttccatattacatatacagaaaataaagtctagaaaagtaatgtgcctccagctggtaaggtttttttttttttaacaancctctttttataactatataagtcaataatagtcatcataagaaacattttttaatgagcaaaaagaaaaaattaaatcacttgagatcacatcatcctgtgataattactattaacattttggctta

SEQ ID NO: 24 - DNA, 1001 bp, Homo Sapiens
  allele 501: 12-461-124 : polymorphic base A or C
  misc_binding 481..500: 12-461-124.mis1, potential
  misc_binding 502..521: 12-461-124.mis2, potential complement
  primer_bind 378..396: upstream amplification primer
  primer_bind 911..928: downstream amplification primer, complement
  misc_binding 489..513: 12-461-124 potential probe
  misc_feature 850: n=a, g, c or t
aatggaaatttatttaaatctcctgtgactattaggctctgagtgtttaaaaattttactctggattaagttatcatgacaattagtagtagtagatcattggaaaaactaacataagtatatatacattttgtgaaatcattattttaaaaagtaaaattttattgaaaatatatcttaataagataggactagtttttcttccaaatacttcttggtgtgtttttttgtttgtttgctttttggttaatatttctaattactagaatgagacaggtttctatatgaattctattcctacttttattttttatagacacaagcaaggaatattgttgacataagtagaaatgaatcttgtaattgcaattttacttaattttctgaatgccttccaagttctcaatcaacaatcacagtgatctgacatccaaaattatttttaaaatgttgatactaccagctaaaaacttgatgagattctcctttaatacagttgamagcagagaattagaaaccacctggcttgcaaaaaggtctgttacccaaacatttgagtcattgtctatttcactattaacatcattatttcaaattctcctttggttgctgcactggaggttttgctttatttgtttgctggtttggggtttttgttgttgttgttgttttctgtctttttaactatataggacaggggttggcaaactaaggccagtttgtactgatcaaatcttgcctagcttgctttcatgcagccctcaggttaagaatggttttcatatttttggtttgtttttttttttaaaaggaagtactacttcttattgatcaaataaattctgctttncttattatcattattttgtatttgctcaaggaaagctacttaaagactaagtaaagaacagagttgggagaggtaaagtaccaacttcttgaccacatgtaaggagttcttagactggccttcctgtgtgtatacttaggtctcaattcac

SEQ ID NO: 25 - DNA, 1001 bp, Homo Sapiens
  allele 501: 12-461-299 : polymorphic base C or T
  misc_binding 481..500: 12-461-299.mis1, potential
  misc_binding 502..520: 12-461-299.mis2, complement
  primer_bind 203..221: upstream amplification primer
  primer_bind 736..753: downstream amplification primer, complement
  misc_binding 489..513: 12-461-299 potential probe
  misc_feature 675,831,997: n=a, g, c or t
tcttaataagataggactagtttttcttccaaatacttcttggtgtgtttttttgtttgtttgctttttggttaatatttctaattactagaatgagacaggtttctatatgaattctattcctacttttattttttatagacacaagcaaggaatattgttgacataagtagaaatgaatcttgtaattgcaattttacttaattttctgaatgccttccaagttctcaatcaacaatcacagtgatctgacatccaaaattatttttaaaatgttgatactaccagctaaaaacttgatgagattctcctttaatacagttgaaagcagagaattagaaaccacctggcttgcaaaaaggtctgttacccaaacatttgagtcattgtctatttcactattaacatcattatttcaaattctcctttggttgctgcactggaggttttgctttatttgtttgctggtttggggtttttgttgttgttgttgttttctgyctttttaactatataggacaggggttggcaaactaaggccagtttgtactgatcaaatcttgcctagcttgctttcatgcagccctcaggttaagaatggttttcatatttttggtttgtttttttttttaaaaggaagtactacttcttattgatcaaataaattctgctttncttattatcattattttgtatttgctcaaggaaagctacttaaagactaagtaaagaacagagttgggagaggtaaagtaccaacttcttgaccacatgtaaggagttcttagactggccttcctgtgtgtatacttaggtctcaattcaccaccnatgataaggcctgctttggcatatactctaaactcagggatgatctcaaaattatatcttctttttttttttttttgagacggagtctcactctgtcacccaggctggagtgcagtggtgtgatctcagctcactgcaagctccccctcccgggttcatgccattnctcc

SEQ ID NO: 26 - DNA, 985 bp, Homo Sapiens
  allele 501: 12-461-465 : polymorphic base C or T
  misc_binding 481..500: 12-461-465.mis1, potential
  misc_binding 502..521: 12-461-465.mis2, potential complement
  primer_bind 37..55: upstream amplification primer
  primer_bind 570..587: downstream amplification primer, complement
  misc_binding 489..513: 12-461-465 potential probe
  misc_feature 509,665,831: n=a, g, c or t
taagtagaaatgaatcttgtaattgcaattttacttaattttctgaatgccttccaagttctcaatcaacaatcacagtgatctgacatccaaaattatttttaaaatgttgatactaccagctaaaaacttgatgagattctcctttaatacagttgaaagcagagaattagaaaccacctggcttgcaaaaaggtctgttacccaaacatttgagtcattgtctatttcactattaacatcattatttcaaattctcctttggttgctgcactggaggttttgctttatttgtttgctggtttggggtttttgttgttgttgttgttttctgtctttttaactatataggacaggggttggcaaactaaggccagtttgtactgatcaaatcttgcctagcttgctttcatgcagccctcaggttaagaatggttttcatatttttggtttgtttttttttttaaaaggaagtactacttcttattgatcaaataaatyctgctttncttattatcattattttgtatttgctcaaggaaagctacttaaagactaagtaaagaacagagttgggagaggtaaagtaccaacttcttgaccacatgtaaggagttcttagactggccttcctgtgtgtatacttaggtctcaattcaccaccnatgataaggcctgctttggcatatactctaaactcagggatgatctcaaaattatatcttctttttttttttttttgagacggagtctcactctgtcacccaggctggagtgcagtggtgtgatctcagctcactgcaagctccccctcccgggttcatgccattnctcctacctcagcctcccgagtagctgggactacaggcacctgccaccatacctggctaatttttttgtatttttagtagagacggggtttcactgtgttagccaggatggtctcgatctcctgacctcgtgatccgcccgcctcggcctccca

SEQ ID NO: 27 - DNA, 1001 bp, Homo Sapiens
  allele 501: 12-462-280 : polymorphic base C or T
  misc_binding 481..500: 12-462-280.mis1, potential
  misc_binding 502..521: 12-462-280.mis2, potential complement
  primer_bind 222..241: upstream amplification primer
  primer_bind 655..675: downstream amplification primer, complement
  misc_binding 489..513: 12-462-280 potential probe
  misc_feature 174: n=a, g, c or t
agggttgctcaggccagtgatgtttgcaatgcaaacccaagaattctgaaaggagcccatggctgaaaggagccaattcttccaggacggactactccagttgcaactgtgctgtggaggctgaggagcatccatgactgaggaagggcgagtcccctataatgcccttgctanggggagcatcagacatccctagacttacaagtccctcgtgtaataaggtgaactatggaaagctatgatttgaggaaagttccctctgattgaaagagttcttcaaatatgaagaatgtaacacttatggggcacctactcattgcaaaacactctactaggggctttcacctgtatgtttaactcattttgttgatttttttttttttaagcccaaatttctgagaggttaaggaacttgtctggtggtggcgtctctgggattctgacttttccactgaccataacatgcatctggtctaaattgagcggaccacccaggaggaygttggaataaaaagaaatgggaagggggtggggagaggaatgggcatagaataaaaaggtagaaacccttgggatcaaaggatgcaactgaaagagcaccaaaatatgcatcattttttttaatatgttgtctggtacccaaaattgggatgcctctgtggtatcaactttgacatttaaagaaagggcataagattagatcattcaaccataagtggaaggaagaaacaaaataaaataaaaccttacaattccctttgaagttgatcaggtgtcaaggcagtgatttggttttcttttacaaactttctttttccagaaaaatttttactgtgggtttggagaggtgtttacaataaattcatagcagagctccaaaagggcccaccccatctaatatcctctgtctcagcagattattgaagaagattggattaaaaggtttgttttgtgatgtgtgatggttgtgtccccaagatgattgagtttgaggcagagtt

SEQ ID NO: 28 - DNA, 1001 bp, Homo Sapiens
  allele 501: 12-464-66 : polymorphic base G or T
  misc_binding 481..500: 12-464-66.mis1, potential
  misc_binding 502..521: 12-464-66.mis2, potential complement
  primer_bind 436..455: upstream amplification primer
  primer_bind 880..900: downstream amplification primer, complement
  misc_binding 489..513: 12-464-66 potential probe
  misc_feature 121,163..164: n=a, g, c or t
aatcttaactccctgaattccctttagttaatggagactctagtacaccatcctgcagtggggccatttccatagctggtgaagaaattttctttcccacagtcttcctcctctctttttncatacttttccctcttttgctttctggccatatgccttcttnnttgctttcctccccttccacctctaactcacagcaattctcttccctctaccaaccagcctgttccaaaaaaaaaaaaaaaaaaaaaaaaggtccccttttattccttagggtagcacttgtttttgttttttaacatccaaatccttcttggagccccttcgtattctctctctgaggaagacggagggggcttccctcatcctcccttgttacctagcaacttgtcttcttcctgacaagtcaccaccctgccaggatgccagctgatgcacacacaataaagggaaagtgagcagacaccaccactccagtccactcatagaggaccctctgckcattagcactccgatgagtggcttgctatgggcaggtcccccagacgcctctcccccagtaagctggccacactgctcctccagggatctcagagagatggcagcttgtcaagttcctgagtcgctgggtatgtactgggaatttcagatttaatccctaattacatccagctcatcacctttgtaataggagccataatcatcttttcattgttgtctttgagtcactggggctgtgtggaacactatatccatattcatgcatgtgttttctattttgctactacatcctcttccttagacttcaaaatgaagggggattttcttttctcctgcaaaagcctttatgaaagaaggtgtttgcttaacactttcaagcttccccattgacatcctttgttctttctctacacattcatggattaactactttgggtccagccgtggtaaccaacttcaatttgtcacagaaaatgtagatgtttttaggtagggcttat

SEQ ID NO: 29 - DNA, 1001 bp, Homo Sapiens
  allele 501: 12-465-26 : polymorphic base C or T
  misc_binding 481..500: 12-465-26.mis1, potential
  misc_binding 502..521: 12-465-26.mis2, potential complement
  primer_bind 476..493: upstream amplification primer
  primer_bind 945..962: downstream amplification primer, complement
  misc_binding 489..513: 12-465-26 potential probe
  misc_feature 556,630,796: n=a, g, c or t
ctttctactttttaatgtggttaccagaaaatttttaattacatattaattagtgacttgctttgtggcttgcgttgtatttctattgaacagtgctggtttagagtttaatgtttactagttcttttgttctactaaattaccacaaaacttcctgcttcatttgtatttatgaggtatatgagttgtggaacgtggactggtttgaaagcaatatttctgcacagacaaattctagggttggctttttgcatactataataactctagacaaatcatggaaattgtgacttccccaggaagatggggactggggggagtgaagtatggaggaagggaaaggaggcttggagaggaaaggaagaaggccatatactccagaggcgataggatcactgaaaaaaactaaatgtgtggcttgcaagaagaggaggtggcctccttctaagatgtcccttgtcattctgaagaagacttcctcccaaaccaactctttcccaytgggcagtcagcttgatctcttgaggttgaggaaggccctgctattaattgtccntaggagaaagagcatatccactgagctatgagtcaatgatctgtcttagggtgggatttattattttcattatnttgtgtgtttgattttcttgttagagttctttccttaggactgtttgttgcttttaacgaggtggatgggggtggtagtgtgctgagcagagcagtgctgatgctgacaacaacaccacagcaaacagcaaacaggacatgcaaagcaggaggcaaactcgtcttncccaaccaacatttagctgaggactagtcagggtgtgtggctattatgttctagtagctaggagagtcccagcatgtgctcttagaggccattttggagagggtgaaatagagaaactagaaacattattcatctcagagactctctggacctgagagagaacagtaactgtattcaggcctaatccctcagatggctgccttgg

SEQ ID NO: 30 - DNA, 1001 bp, Homo Sapiens
  allele 501: 12-465-234 : polymorphic base G or T
  misc_binding 481..500: 12-465-234.mis1, potential
  misc_binding 502..521: 12-465-234.mis2, potential complement
  primer_bind 266..283: upstream amplification primer
  primer_bind 735..752: downstream amplification primer, complement
  misc_binding 489..513: 12-465-234 potential probe
  misc_feature 346,420,586,869..870,876..877: n=a, g, c or t
gcaatatttctgcacagacaaattctagggttggctttttgcatactataataactctagacaaatcatggaaattgtgacttccccaggaagatggggactggggggagtgaagtatggaggaagggaaaggaggcttggagaggaaaggaagaaggccatatactccagaggcgataggatcactgaaaaaaactaaatgtgtggcttgcaagaagaggaggtggcctccttctaagatgtcccttgtcattctgaagaagacttcctcccaaaccaactctttcccattgggcagtcagcttgatctcttgaggttgaggaaggccctgctattaattgtccntaggagaaagagcatatccactgagctatgagtcaatgatctgtcttagggtgggatttattattttcattatnttgtgtgtttgattttcttgttagagttctttccttaggactgtttgttgcttttaacgaggtggatgggggtggtagtgkgctgagcagagcagtgctgatgctgacaacaacaccacagcaaacagcaaacaggacatgcaaagcaggaggcaaactcgtcttncccaaccaacatttagctgaggactagtcagggtgtgtggctattatgttctagtagctaggagagtcccagcatgtgctcttagaggccattttggagagggtgaaatagagaaactagaaacattattcatctcagagactctctggacctgagagagaacagtaactgtattcaggcctaatccctcagatggctgccttggcggccactctctttaccatgaaaattgccccccagatggaaacctcttgaacttggaaaaacctctttatttccaaanncagaannaaaaaaaaatcactatgtatttcttcttaagaaaaaaaaattgttattcaactactgtgtcccattttcccaataaacattaattgaactgctagtgggcaccattcatccatttaacaaatac

SEQ ID NO: 31 - DNA, 1000 bp, Homo Sapiens
  allele 501: 10-428-219 : polymorphic base A or G
  misc_binding 481..500: 10-428-219.mis1, potential
  misc_binding 502..521: 10-428-219.mis2, potential complement
  primer_bind 278..295: upstream amplification primer
  primer_bind 613..632: downstream amplification primer, complement
  misc_binding 489..513: 10-428-219 potential probe
  misc_feature 203,238,334,348,369,374..376,645,675: n=a, g, c or t
actcttttatatcataaagtaaaactactttacagatgaggaaactatctatttgatgtacacaataatttctctaaattctttcagctagtcagtgggttgttgagctagaatctgaggaatccagatcccatcctttcattgattatgtcactaagataagtcacagaatcttcttttagggaagttttcaagaatagtangtaagctgctatcttaaaatattgatgtcagtagncctgggaattttaccacgtatgcaagcatgggataagacaaccacaggtttctcttctgtaccagttaacctgttttatgattatttcaagttgtngaataaaagcttgnaaaattggcaggatctgtttngaggnnnttactcaaggatatttattacttgtttcaggaacagcatctgttgcagttgcaggtctccttgcagctcttcgaataaccaagaacaaactgtctgatcaaacaatactattccaaggagctggrgaggtatttgccttgtgtaatacttatgttctcctaaactaacatataattagtgttaattgctcattaactcaagatttgacgtattctttcaaatttttagtatattatgactgtaggctttatggaagattcccaaattanagtactgagacatattaattattcataggnataatttagtacagaagtaatgagatatttttcacagttttaaatttgtggtattatcaaatgttgccgtaggtatttgttatgcatatctaaggtgccatacaggaaaactttccaatgtatgtgtatatatgcaagcttttatgtatttaagctggtttatctgatactggcttttagtatactccagtgttacaaaaacaagtttttaaaatttgactcacaattcagtgtgtatgtatgtaactacatatgtgtttttaagaaaaaacattttgaattagggatttgtagtatattattactgttcacatgcaaaaatccc

SEQ ID NO: 32 - DNA, 1001 bp, Homo Sapiens
  allele 501: 10-429-84 : polymorphic base C or T
  misc_binding 481..500: 10-429-84.mis1, potential
  misc_binding 502..521: 10-429-84.mis2, potential complement
  primer_bind 418..436: upstream amplification primer
  primer_bind 823..842: downstream amplification primer, complement
  misc_binding 489..513: 10-429-84 potential probe
  misc_feature 222: n=a, g, c or t
taattataaaatttaccaaataccaaggaagttgattcctttaatcttgcaataaatttcacagcacttttggtatccaaattagaagagtaagtagatgcttggaaacacagatcttttatttttcatcagtttcattctgttgcctaattggtcaagttcccatccaaatgaccaagcttctttcttcaaattcaattagagtagcttgaacctaacaantaaacaatacagttcaatgagcaaggttgaccagttcattattttgaattcagtattttttcttggagcaaatcttggttgtattaacaggattaaatacactgacaatcaaggatatcaccagtttatctgtggccaaatagcaagccacataatagtggctctgttgtagtaaaaagggtaaataattgttatttggcttaacctaaatgtgacaaaaatattttgttcccactaacaaagacaaaatggggtgaaatgtaacccttaataagataycatgtagaacaactttaaaattttttcttttcatcactgaggctgccctagggattgcacacctgattgtgatggccttggaaaaagaaggtttaccaaaagagaaagccatcaaaaagatatggctggttgattcaaaaggattaatagttaaggtaagaatttgtcatttttaaccagaataaagataactatgccattctggatggccatctcaaagacaactctgtttctaccacctccctttacactatattaaaagagtagccattaaatacaaatgatcatgtcatacagaatactgatactcttctgaataaagaaaactatgacttaggaacagattccatctgcaatgtgagtcggctccttacacccctttgaattgacagtccatttgaattagtttagttttctttctttctttccttcctttctttcctttctctttctttctttctttttctttctttccttccttccttcctttccttcctttt

SEQ ID NO: 33 - DNA, 1001 bp, Homo Sapiens
  allele 501: 10-420-284 : polymorphic base C or T
  misc_binding 481..500: 10-420-284.mis1, potential
  misc_binding 502..521: 10-420-284.mis2, potential complement
  primer_bind 216..235: upstream amplification primer
  primer_bind 646..665: downstream amplification primer, complement
  misc_binding 489..513: 10-420-284 potential probe
  misc_feature 42,308,413: n=a, g, c or t
agcctatcggttgaaccactgcagagaatagagtgatggtcnttagggcatcctgtactttgcatgctcctcctggaagtaaagagtaagacagagaatagtaataatcacccattccagaactggttgcacaacatcacaaaagcttgtccagacttattagcaagttaataaaaaactagacttctttctaagtacttataatttaggctgtggggtagttctgttatgatacatttgttttaaaatattctgcttctttttaaagtgagttgtatgtgtctttgttgtagggacgtgcaattttntgccagtggcagtccttttgatccagtcactcttccaaatggacagaccctatatcctggccaaggcaacaattcctatgtgttccctggagttgctcttggtgnttgtggcgtgtggattgaggcagatcacagataatattttcctcactactgctgaggtattgtaaaatcctctaagtttaccaagggyttaaaataccaagtgtgctcagcctaggttgtctaatgttttatttatctagcatctcagcttactctctgaaagaagtaaagtctgaagaacttcccagtggagtataaggggtgggtagcatgttcatactgactcacaaacgaaaggttcttcttcagtagtcattagaaaaattgtgtttttgatttcttaagaggaacatttttgtgtcttcacacatcagatcaagttctgtgacagtgatgggacaattaaaaatattgtttccagggctgggtgtggtggctcatgcccctaatcccagcactttgggaggctgaggcaggcagatcacttgagcccaggagttcgaggccagcttggccaacatggtgaaacttcatctctactaaaaatacaaacattagccgggcatggtggtgtgtgcctgtgatcccccctgactcaagaggctgaggcaggagaattgcttgaatccaggaggcagaggttgcagt

SEQ ID NO: 34 - DNA, 821 bp, Homo Sapiens
  allele 501: 10-423-411 : polymorphic base C or T
  misc_binding 481..500: 10-423-411.mis1, potential
  misc_binding 502..521: 10-423-411.mis2, potential complement
  primer_bind 91..109: upstream amplification primer
  primer_bind 510..528: downstream amplification primer, complement
  misc_binding 489..513: 10-423-411 potential probe
  misc_feature 5,804: n=a, g, c or t
cctangattctattcccatctttttcaccaattatgtgatctcaaccaccaccacaccactctgggcttatttctttgttgatagaagtggggatgaaattaggtaatcatattaatgtcactggtttttgtatagaccattatatgtaaccgttcacttagttattggcgtacccaccacattgtatcgtgtgaagtataaacactttttttctttctttttttcataaggttatagctcagcaagtgtcagataaacacttggaagagggtcggctttatcctcctttgaataccattagagatgtttctctgaaaattgcagaaaaggtaaaaccactcttgttcaagcttcattatttttccttccttttcttgctaaatatgcatttttaaatattaaaaatctgcttccttgaaatgtatatctgtatcaacttactatgtcagaagtcagagaaatgaggcacactgacactgtagagcttaggagctacattygcttctcagagaagaatggaagtattggggccgaataattaatttccctctctatcgttctttttttctcctaaaatttaaataattcattagggcttcctgtcagccagatttctcccatttcacctttttaaagttgttcttttctatatcacattagtgataattaaccaaaatattacagatatgttagagtaacatttagaccttgaaccaccttccatatccatgtcactatgatgtgtggcatcataaatgacagatcacaactgataatactgggcggaaggcaaaataaagagntcaaagaacttgaaagc

SEQ ID NO: 35 - DNA, 732 bp, Homo Sapiens
  allele 232: 12-713-95 : polymorphic base C or T
  misc_binding 213..231: 12-713-95.mis1
  misc_binding 233..252: 12-713-95.mis2, potential complement
  primer_bind 137..153: upstream amplification primer
  primer_bind 586..604: downstream amplification primer, complement
  misc_binding 220..244: 12-713-95 potential probe
  misc_feature 154: n=a, g, c or t
ggtctcttctgtgaccccattattgtcctgtgcatttatctcaagatcagattcattattaaatctatccagacaattcctctatcatgtccttgatccatttctataaccataacccagtttctataatcataacccaacttcaccattttantatctttacaccatctcggtaacttctgattttctttaggatcatattaataagtattcaggaacttacctttacccygctattgactgttttcacctacatataaatccctttgtgatctggcccatgcacttcaccttcctgtctgccatcctccacccctccgtgtatcctttacaccattgtataaataaatagttttagttggctgcacatgtcattgttctgtcacacttcttctctgtataaactgctccttcttcccccagtgcttttgcttatttaattcatgcttatctttcataactcaggttaaatatctagactggattagagaagttttctgtatagtatcctagcatggatacaccaaaatagcatgtatcacactgtattgtaattatatgtatttatttgacttagcattaagtcatcaagatattagaggtcagggcctcattcttttctctcttcctttataatatatgttgttactgtgatacttctttttaataactttaattttaagttcaggagtacatgtgcaggtttgttacataggtgaccttgtatgatgg

SEQ ID NO: 36 - DNA, 786 bp, Homo Sapiens
  allele 286: 12-713-149 : polymorphic base G or C
  misc_binding 266..285: 12-713-149.mis1, potential
  misc_binding 287..306: 12-713-149.mis2, potential complement
  primer_bind 137..153: upstream amplification primer
  primer_bind 586..604: downstream amplification primer, complement
  misc_binding 274..298: 12-713-149 potential probe
  misc_feature 154: n=a, g, c or t
ggtctcttctgtgaccccattattgtcctgtgcatttatctcaagatcagattcattattaaatctatccagacaattcctctatcatgtccttgatccatttctataaccataacccagtttctataatcataacccaacttcaccattttantatctttacaccatctcggtaacttctgattttctttaggatcatattaataagtattcaggaacttacctttaccctgctattgactgttttcacctacatataaatccctttgtgatctggcccatgcasttcaccttcctgtctgccatcctccacccctccgtgtatcctttacaccattgtataaataaatagttttagttggctgcacatgtcattgttctgtcacacttcttctctgtataaactgctccttcttcccccagtgcttttgcttatttaattcatgcttatctttcataactcaggttaaatatctagactggattagagaagttttctgtatagtatcctagcatggatacaccaaaatagcatgtatcacactgtattgtaattatatgtatttatttgacttagcattaagtcatcaagatattagaggtcagggcctcattcttttctctcttcctttataatatatgttgttactgtgatacttctttttaataactttaattttaagttcaggagtacatgtgcaggtttgttacataggtgaccttgtatgatgggggtttgttgtacagattatttcatcacccaggaactaagcatagtactcgtta

SEQ ID NO: 37 - DNA, 902 bp, Homo Sapiens
  allele 500: 12-716-295 : polymorphic base C or T
  misc_binding 477..499: 12-716-295.mis1
  misc_binding 501..520: 12-716-295.mis2, potential complement
  primer_bind 206..225: upstream amplification primer
  primer_bind 727..746: downstream amplification primer, complement
  misc_binding 488..512: 12-716-295 potential probe
  misc_feature 67,139,690,834: n=a, g, c or t
caatgtgtactacaaaaataaaatgcatgcaatttagagtcactattgcaataattatgaactgtgntaagtcatatattatgaaaaagccactcttctatacattacttaaggtgaaaatctatgcaaaaaatatggntagtgtatgtagagaatatatcatgacatgattagaatgatattttccccatgcaagatatattcactagagtcattaaacagatgaaagagaatttaaactagaaagagaggtatagatatccacttactaaataagaagttattcagaaatagtagctcaagctatctctctcttgggttcttttgaagtaaactgcccagaagtttggatctggggaactctaagctcccttccaactctgagattctatgattttaagggtttctataagatttaaccagttgaagcatcaaagttgaagtatcatcagcaatcactgtatttgtattattatttttatttacatcgaattggacayttacggtcagatagacagaaaatattctaaaatatcctatttggtaccttaatttcatatggttatgctagatcacttaaaactcaaaatgtgttaagttcatacattatatttaaagatatatttcataatatttcctgagaacacaatgaaaacactaatcttccatttatagaattaattaataaanatcagaaagatatttttagcactatcaaaaatttaacttgaacatgattcttgtacatggcctggtactaccttgatttaaatttcattgcagagaagggaatacatgtagaaaattgaaatttcataaaactgtaaatttttnacaataaattattccataataagttttactttaagatttaaaactaagctttttataagtcagacaga

SEQ ID NO: 38 - DNA, 981 bp, Homo Sapiens
  allele 480: 12-720-80 : polymorphic base G or C
  misc_binding 461..479: 12-720-80.mis1
  misc_binding 481..500: 12-720-80.mis2, potential complement
  primer_bind 400..419: upstream amplification primer
  primer_bind 856..876: downstream amplification primer, complement
  misc_binding 468..492: 12-720-80 potential probe
  misc_feature 191,218,225,437,480,694,772,775: n=a, g, c or t
ctgcaggaaacatttggcaatgtctggaagctttgagttgtcttaactagggtagcggggttggaagggagtaaagggaggggctactgacatctagcagatagaggcagcggaatgattctactaaatatcctgtagtgcactggacagcccctgcgacaaggaattatccagcctaaaatgtcaatagntgctgaggttgagaaatactgcagtangataagnaccctcctggaagacagggatcacatctcacaaatctttattttccttatagcacttaatacagtacttacacaatgcatgtgcagtgcaagactttaaagtggttttagaaaactcaaaggaatttatgaaactttattctttattttgtgcatatataattttgatttttaccttgtattatactccattcctacaagctcttgtgaaancagatgacaacgttgaaaataatgatgataactacaataaaasgaagtacttactccatgacaggaactttactaagtgtttaatattgtttttacaaaatatattctgtcaataatcttattgtttttcatttccattatgctaattgctttattcttctgttaaagttacttcagtgggtggtactttacttttgcagatgaatcagatggttgtcttaagtgatagcgttggtttataaaacttaattgctttngtagcctgacaagactgaaatatactcatagaattgcttataaagaaagtttacacattagatacaaatttccaagtnganttggtaactaactcaatgtactatggaagccaaatattatctttagtttttaatagatatttgtagatttgtgaccctaaggattgtaaggattgttggcattaacaaacttgcctctttttgtcactatacttgaatacaaatagtttatatagcattttgtttagggtctattagaaaatgagctgatagatatcattgatttg

SEQ ID NO: 39 - DNA, 872 bp, Homo Sapiens
  allele 372: 12-721-227 : polymorphic base C or T
  misc_binding 352..371: 12-721-227.mis1, potential
  misc_binding 373..392: 12-721-227.mis2, potential complement
  primer_bind 146..165: upstream amplification primer
  primer_bind 588..607: downstream amplification primer, complement
  misc_binding 360..384: 12-721-227 potential probe
  misc_feature 756,794,799: n=a, g, c or t
aaattaatgagttaaatgatgagtttattataaaattatggtcaacaccctacaattatatgttataatattttgtataatatgtagagcaatactaatcaaacaaatagttatactagtaactttacctccttctcctttccatcttacctctgcctaaatgtccctggtcagaagtccttagtcaccgacgggatttaactccaaactccttttttgacattgataatgctccagtccttatttctgtacccagaccctctgctcccccaggtcaggacacttgggcctgctgagtccagctcacacacaactctgcctttggtctgactctgttttttgtctgaaatgcctacctactttctgtttgtytaactccaggctttcctgtaggtttgcctttcaagccactgtgcactataaggccttccagaactgctcttcctctggatttcttagcacccacatttcaccattagcctaagccgtcttctctttcagcgttctctttttcttcccgtactctgttaccttactaaattatacatctctcaaggacaataacacttttcttaagcttctccgtagtgttatgcttgttcagtgcatatatgtttgctgatggcaaagaataatattttggaaataatttcatgatttaaaaatctaaaagatattaagatatactgaaaaataagtatttgattatttaaaatgttacaaaagaggaaggtttcctactccctctctgcatcncacattttcatggaacaaaggcctaggtataagctgantttangatttgcccccatctagaaatttaatcaaagtcttagagctggagagaacatcagggttactgagtctccctc

SEQ ID NO: 40 - DNA, 926 bp, Homo Sapiens
  allele 426: 12-721-281 : polymorphic base A or C
  misc_binding 406..425: 12-721-281.mis1, potential
  misc_binding 427..446: 12-721-281.mis2, potential complement
  primer_bind 146..165: upstream amplification primer
  primer_bind 588..607: downstream amplification primer, complement
  misc_binding 414..438: 12-721-281 potential probe
  misc_feature 756,794,799,893: n=a, g, c or t
aaattaatgagttaaatgatgagtttattataaaattatggtcaacaccctacaattatatgttataatattttgtataatatgtagagcaatactaatcaaacaaatagttatactagtaactttacctccttctcctttccatcttacctctgcctaaatgtccctggtcagaagtccttagtcaccgacgggatttaactccaaactccttttttgacattgataatgctccagtccttatttctgtacccagaccctctgctcccccaggtcaggacacttgggcctgctgagtccagctcacacacaactctgcctttggtctgactctgttttttgtctgaaatgcctacctactttctgtttgtctaactccaggctttcctgtaggtttgcctttcaagccactgtgcactataaggmcttccagaactgctcttcctctggatttcttagcacccacatttcaccattagcctaagccgtcttctctttcagcgttctctttttcttcccgtactctgttaccttactaaattatacatctctcaaggacaataacacttttcttaagcttctccgtagtgttatgcttgttcagtgcatatatgtttgctgatggcaaagaataatattttggaaataatttcatgatttaaaaatctaaaagatattaagatatactgaaaaataagtatttgattatttaaaatgttacaaaagaggaaggtttcctactccctctctgcatcncacattttcatggaacaaaggcctaggtataagctgantttangatttgcccccatctagaaatttaatcaaagtcttagagctggagagaacatcagggttactgagtctccctctctgccttagggttcaatacnaaaatttaacactgtttgatttggaactaggga

SEQ ID NO: 41 - DNA, 1000 bp, Homo Sapiens
  allele 501: 12-721-440 : polymorphic base A or G
  misc_binding 481..500: 12-721-440.mis1, potential
  misc_binding 502..520: 12-721-440.mis2, complement
  primer_bind 62..81: upstream amplification primer
  primer_bind 504..523: downstream amplification primer, complement
  misc_binding 489..513: 12-721-440 potential probe
  misc_feature 672,710,715,809: n=a, g, c or t
tagagcaatactaatcaaacaaatagttatactagtaactttacctccttctcctttccatcttacctctgcctaaatgtccctggtcagaagtccttagtcaccgacgggatttaactccaaactccttttttgacattgataatgctccagtccttatttctgtacccagaccctctgctcccccaggtcaggacacttgggcctgctgagtccagctcacacacaactctgcctttggtctgactctgttttttgtctgaaatgcctacctactttctgtttgtctaactccaggctttcctgtaggtttgcctttcaagccactgtgcactataaggccttccagaactgctcttcctctggatttcttagcacccacatttcaccattagcctaagccgtcttctctttcagcgttctctttttcttcccgtactctgttaccttactaaattatacatctctcaaggacaataacacttttcttaagcttctccrtagtgttatgcttgttcagtgcatatatgtttgctgatggcaaagaataatattttggaaataatttcatgatttaaaaatctaaaagatattaagatatactgaaaaataagtatttgattatttaaaatgttacaaaagaggaaggtttcctactccctctctgcatcncacattttcatggaacaaaggcctaggtataagctgantttangatttgcccccatctagaaatttaatcaaagtcttagagctggagagaacatcagggttactgagtctccctctctgccttagggttcaatacnaaaatttaacactgtttgatttggaactagggaatggtttggggacagtaaatgttgaggctaattaggtgatttagataatccagagtctgtgtaaaattaaaatcctatttgtagtgagactctgaactagctttctcagccttttgctctacctcctgcacaagaatatgactcagagctgggagtaa

SEQ ID NO: 42 - DNA, 1001 bp, Homo Sapiens
  allele 503: 12-723-293 : polymorphic base C or T
  misc_binding 484..502: 12-723-293.mis1
  misc_binding 504..523: 12-723-293.mis2, potential complement
  primer_bind 210..230: upstream amplification primer
  primer_bind 591..610: downstream amplification primer, complement
  misc_binding 491..515: 12-723-293 potential probe
  misc_feature 312,379: n=a, g, c or t
ctcattagttctcagacatttgaatagtccttctccagtgcatagttacttgggtaaagggctgtagttccctgtggataaagattagggggattattaccctgtattcttgtcatggtgttataaggttctttcttctgggaactaggcctcttcttcagtttatgggttctgggtctaaaaattaactcaggttcggaagctgagcaagagattgtgacttcattggggcagctacactcaactttgtggtcattcatctttggtttcttttgatagtaaatattgagtagtagctttgttagctctccngttttgcctctagggatgcaagattccgttaattatctcaaaaacattttgtgggttagccacacancaccccacttttgccactcttatgataattgtgtccatctggcttctgattgttaagcattctcacctggtcttagcatccttattgctatcagtcaggctggttatatatcatccttttcttytgtcactcctgaccttcaggggagaaccaccactgaaatttttagtaatgttgatgtcttctcattggcatattccttatggctttgggaaatggtgtgttttctgggccttcctgtggaatatgttcatcttatggattttctggcttttacatgtgtctatataccagactgcccagttctctgagcctcgcaatcccctcttctgtcatttgccacagcattcctggcatttcagtcatattagtatcagccattaatttgtccatgtttctaggaaccatcctagcaatgagtttgcaccatcttctgggattcttgccacatgttaaatcctgtatctcaggagagtgcctgcaaatcagtaagctctcccttttcctaggttccagcccttttaatcaaacaccctcagaatttaattctacatgtattctcctggctaatacaaatactggtcttgtggctcctttggggtaaagtctctttcttccttta

SEQ ID NO: 43 - DNA, 1001 bp, Homo Sapiens
  allele 501: 12-724-195 : polymorphic base C or T
  misc_binding 481..500: 12-724-195.mis1, potential
  misc_binding 502..521: 12-724-195.mis2, potential complement
  primer_bind 307..326: upstream amplification primer
  primer_bind 797..817: downstream amplification primer, complement
  misc_binding 489..513: 12-724-195 potential probe
  misc_feature 244,249,631,669: n=a, g, c or t
tcacctgaggtcaggagttcgagaccagcctggccaacatggtgaaaccctgtctctactaaaaatacaaaaattagctaggcgtggtggcaggcgcttgtaatcccagctacttgggaggctgaggcaggagaatcacttgaacccaggtggtggaggttgcagtgagccgtgattgcaccaccgcactccagcctgggcaacagagcgagaatccatctcaaaaaaaaaaaaaaaaagaaanaaganaaagcatgaagtatgtggaggcatacatgaaaagagacaaatgacatgttatttttacattttaataggcaaccaagtataacaataatgtgaagcaagactttctaattatgtgcacaggccatctgatggacggcaaaggtggaacatggggagatgagtatgtgaaagagggaacatcatggcctctgagctgaaggcagcatgggtacaggctcaaatcctcagagaagctttggctctaaaggactyatctgtgcttcaacataccactgtattctcctatttctagtttgtaccattccttatgcctaaaatgccttcatataagggatgcagaaatttagaaaatgcttttataaactccatgtgcaaacttacnaatagagaattaaaggtctcctcaaagcatgttccagntaaatacctcatctccaacctcaatcatgtcatttacttctgtagtttgaatcactaaatctgtgactttttctccatttagcctgaatcaaactgtttatttctaaaagccagcaacttctatgaacactaagggtcacatattcagcagaaaagagaattgtatattattttactgaagaatattacagtcataaaattttagatctagaaatgtcctcagagatgatttagcaataactaatgaccaggaaggttaaaaaacacccaaggttccagaaaaatatatggtagtgagtgttgccatctaagagaaaagccagagggactaa

SEQ ID NO: 44 - DNA, 1001 bp, Homo Sapiens
  allele 501: 12-724-225 : polymorphic base C or T
  misc_binding 482..500: 12-724-225.mis1
  misc_binding 502..521: 12-724-225.mis2, potential complement
  primer_bind 277..296: upstream amplification primer
  primer_bind 767..787: downstream amplification primer, complement
  misc_binding 489..513: 12-724-225 potential probe
  misc_feature 214,219,601,639: n=a, g, c or t
tggccaacatggtgaaaccctgtctctactaaaaatacaaaaattagctaggcgtggtggcaggcgcttgtaatcccagctacttgggaggctgaggcaggagaatcacttgaacccaggtggtggaggttgcagtgagccgtgattgcaccaccgcactccagcctgggcaacagagcgagaatccatctcaaaaaaaaaaaaaaaaagaaanaaganaaagcatgaagtatgtggaggcatacatgaaaagagacaaatgacatgttatttttacattttaataggcaaccaagtataacaataatgtgaagcaagactttctaattatgtgcacaggccatctgatggacggcaaaggtggaacatggggagatgagtatgtgaaagagggaacatcatggcctctgagctgaaggcagcatgggtacaggctcaaatcctcagagaagctttggctctaaaggacttatctgtgcttcaacataccactgtattctyctatttctagtttgtaccattccttatgcctaaaatgccttcatataagggatgcagaaatttagaaaatgcttttataaactccatgtgcaaacttacnaatagagaattaaaggtctcctcaaagcatgttccagntaaatacctcatctccaacctcaatcatgtcatttacttctgtagtttgaatcactaaatctgtgactttttctccatttagcctgaatcaaactgtttatttctaaaagccagcaacttctatgaacactaagggtcacatattcagcagaaaagagaattgtatattattttactgaagaatattacagtcataaaattttagatctagaaatgtcctcagagatgatttagcaataactaatgaccaggaaggttaaaaaacacccaaggttccagaaaaatatatggtagtgagtgttgccatctaagagaaaagccagagggactaagtccaatagccacgtacggtagagcagacc

SEQ ID NO: 45 - DNA, 421 bp, Homo Sapiens
  allele 330: 10-153-329 : polymorphic base G or T
  misc_binding 310..329: 10-153-329.mis1, potential
  misc_binding 331..349: 10-153-329.mis2, complement
  primer_bind 1..20: upstream amplification primer
  primer_bind 402..421: downstream amplification primer, complement
  misc_binding 318..342: 10-153-329 potential probe
agagtcaccctbggtcttaggtagtaggtggagctgagggataatggcccaaggccaagagttgatccttccaactttgttcagtgatccagctttcatatcaggtgatcaggacaaccaggccaatctgatagggggcggtgtttataaaaaggccactcacctagagccagaagctccacaccagccattacaaccctgccaatctcaagcacctgcctctacaggtacctttcttgggaccaatttacaatctctgggatccccaactatagaacctggaagctagtggggacagaaagacggggagcctgggctaggtgtaggggkcctgagttccgggctttgctacccagctcttgacttctgtttcccgattttaaatgagcagtttggactaagccatttttaaggagagcga

SEQ ID NO: 46 - DNA, 428 bp, Homo Sapiens
  allele 342: 10-95-342 : polymorphic base A or G
  misc_binding 322..341: 10-95-342.mis1, potential
  misc_binding 343..361: 10-95-342.mis2, complement
  primer_bind 3..21: upstream amplification primer
  primer_bind 404..422: downstream amplification primer, complement
  misc_binding 330..354: 10-95-342 potential probe
  misc_feature 192,253..254,424..425: n=a, g, c or t
rwtccctccttttttccctgcagttggtacagatggcattgtcccagtctgttcccttctcggccacagagcttctcctggcctctgccatcttctgcctggtattctgggtgctcaagggtttgaggcctcgggtccccaaaggcctgaaaagtccaccagagccatggggctggcccttgctcgggcatntgctgaccctggggaagaacccgcacctggcactgtcaaggatgagccagcgctacggggnngtcctgcagatccgcattggctccacgcccgtgctggtgctgagccgcctggacaccatccggcaggccctggtgcggcagggcgacratttcaagggccggcctgacctctacacctccaccctcatcactgatggccagagcttgaccttcagcacagactctggagnnata

SEQ ID NO: 47 - DNA, 373 bp, Homo Sapiens
  allele 277: 10-100-277 : polymorphic base C or T
  misc_binding 258..276: 10-100-277.mis1
  misc_binding 278..297: 10-100-277.mis2, potential complement
  primer_bind 1..18: upstream amplification primer
  primer_bind 355..372: downstream amplification primer, complement
  misc_binding 265..289: 10-100-277 potential probe
tagggatggagatggcggtgggcaggctgtctggatggggtggaggtaggagcaacacatgccccagctttccagccctgagcctcacagtgccctcttccctcctcagcacaacaagggacacaacgctgaatggcttctacatccccaagaaatgctgtgtcttcgtaaaccagtggcaggtcaaccatgacccgtgagtacatacccctcacgaaaaaatgtgtgcaggttcagcagtcaggaaggctgtttgtccctgctaggaactgtttayataatgaaaggaggggacctcaattgctatagtctgctctaagtgacgatatttacaaaagtttcacaaactttagtgcacaggaatcaactaggg

SEQ ID NO: 48 - DNA, 375 bp, Homo Sapiens
  allele 297: 10-102-294 : polymorphic base C or T
  misc_binding 278..296: 10-102-294.mis1
  misc_binding 298..317: 10-102-294.mis2, potential complement
  primer_bind 1..18: upstream amplification primer
  primer_bind 356..375: downstream amplification primer, complement
  misc_binding 285..309: 10-102-294 potential probe
  misc_feature 30,218: n=a, g, c or t
agagwgctgtgggaggacccctctgagttncggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgncctgacccccatctacgggctgaccatgaagcacgcccgctgtgaacatgtccaggcgcggctgcgcttctccatcaaytgaagaagacaccaccattctgaggccagggagcgagtgggggccagccacggggactcagcccttgtttctcttcct

SEQ ID NO: 49 - DNA, 1001 bp, Homo Sapiens
  allele 501: 10-413-394 : polymorphic base A or G
  misc_binding 482..500: 10-413-394.mis1
  misc_binding 502..520: 10-413-394.mis2, complement
  primer_bind 108..125: upstream amplification primer
  primer_bind 539..556: downstream amplification primer, complement
  misc_binding 489..513: 10-413-394 potential probe
tgtgatttgtgtaccaattgcctgggtcattgcgtggcacatcacaggccatctataagtggcagctataacaatcaccatcacatttatgtacaaaattcagaaatatcgaatctatgtgtggcaaatatgaacattaaaaaatacaatgaaaatgtcagtctgaatcatacatagtatttggagcaaatagcgacttattttgctgctatttgcatttcctttcccagttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggtaggtgcacatatttctgtgtcagctttggtaactggggtgagggggatggaaaacagagccctaaaaagcttctcagcagagcttagcctatctgcatggctgccragtgttgcagcactttcttccttggctgtgaattctcccagtttctgcccctttttttattaggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaagggtgggtgactctactctgcgtcattgaccttaacagttacctgtcttcactagtgacgtccttggaaacatttcaggggtggccaggtcttcattgcgcatcctggttgtcagccctcaggtggtggagggagatttgaagcacagagacaagggaggttttgtgtatctgtgctttgcctgtataaatgtgttggttcatagggtgtaggaataaaaggtcatttaatcctattttctgctcaattttgtttccttgttttcaaatcagaaattataaataagggt

SEQ ID NO: 50 - DNA, 1001 bp, Homo Sapiens
  allele 501: 10-414-243 : polymorphic base A or G
  misc_binding 481..500: 10-414-243.mis1, potential
  misc_binding 502..521: 10-414-243.mis2, potential complement
  primer_bind 259..276: upstream amplification primer
  primer_bind 592..609: downstream amplification primer, complement
  misc_binding 489..513: 10-414-243 potential probe
  misc_feature 981: n=a, g, c or t
atgaaaatgtcagtctgaatcatacatagtatttggagcaaatagcgacttattttgctgctatttgcatttcctttcccagttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggtaggtgcacatatttctgtgtcagctttggtaactggggtgagggggatggaaaacagagccctaaaaagcttctcagcagagcttagcctatctgcatggctgccaagtgttgcagcactttcttccttggctgtgaattctcccagtttctgcccctttttttattaggaatcatttccagcaatggaaagagatggaaggagatccggcgtttctccctcacaaccttgcggaattttgggatggggaagargagcattgaggaccgtgttcaagaggaagctcactgccttgtggaggagttgagaaaaaccaagggtgggtgactctactctgcgtcattgaccttaacagttacctgtcttcactagtgacgtccttggaaacatttcaggggtggccaggtcttcattgcgcatcctggttgtcagccctcaggtggtggagggagatttgaagcacagagacaagggaggttttgtgtatctgtgctttgcctgtataaatgtgttggttcatagggtgtaggaataaaaggtcatttaatcctattttctgctcaattttgtttccttgttttcaaatcagaaattataaataagggtcttgagttcatttttgaagagttaaagaaggtttcccccatagcataaatctgcattacctccaccagaacatttcaccagagaacacttggaaagtggacatggtgaaagtgacctcatcacacttnatgaaatatgaaccaagtta

SEQ ID NO: 51 - DNA, 1001 bp, Homo Sapiens
  allele 501: 10-416-273 : polymorphic base A or T
  misc_binding 482..500: 10-416-273.mis1
  misc_binding 502..520: 10-416-273.mis2, complement
  primer_bind 229..246: upstream amplification primer
  primer_bind 630..649: downstream amplification primer, complement
  misc_binding 489..513: 10-416-273 potential probe
  misc_feature 619,997: n=a, g, c or t
aaataatgtattacttaaatttgtattgtcatatatgctaatttatagaaatgtacttatgcactgtaatgactagtttgtaggagagtggtatgtatctatattatggtaattctttttatatggctggttgtacttctggacatgtaactcatgtttgtaatgttgctgggatttttatatcatgttaatgtggccatgaattgctatgacaaatgttccatatatcttcgtttccatcagttctttcttgtgtcttgtcagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaaggtaagcttgtttctcttacactatatttctgtacttctgaaatttccawagtgctggtttggttccaaccctctaacaacacaagatgagagaagtgcaaaactcatacatgtggcagcttgatggactttctgctattttgtttggggctataaagatttataaangctaggtctccttaataggctgctcttaggtgttacactttcaaataattgttgaaaatatcagtgtgtcaatttcccaaaacactcttctgagatttttatcaaagtgacattcattgtgtagttcgatatggaaagacttaacatgttcatgcattgaattttttaattcatgaatatggttatgctcccaacttattgagctttattctattttctcagtaatgtcttattttcagtgcagtggtttacaactcttttattaggtttttcctagataattaatattttgttgtgttataattttttaatttttttttatttctttgtaattggtataagtaattgtattcaattatactattctgatgaccttanatct

SEQ ID NO: 52 - DNA, 1001 bp, Homo Sapiens
  allele 501: 10-418-177 : polymorphic base A or G
  misc_binding 481..500: 10-418-177.mis1, potential
  misc_binding 502..520: 10-418-177.mis2, complement
  primer_bind 325..342: upstream amplification primer
  primer_bind 659..676: downstream amplification primer, complement
  misc_binding 489..513: 10-418-177 potential probe
  misc_feature 68,174,203,619,885,890,897,907,918: n=a, g, c or t
ggttgtcatcccagatgacatcatattaaaatagattacatgtttatttacaaaagttctatgaacangatactctggacatttcaagtgtcaacagagacttccattttaaaccataatctacataatcaaaatacaagatgtgtcaaatttgaagtgatgaaatagagcggncaaatgaggccagaaaagggcatccaaancttgatgatctggagaacacattcagaaggttgcacacaagtatccaagatgtaagacttcaaatgtgattggaaagctctttagcaagcttccaccactggccttaagctcatccatgtaaattactgtgtctggctggacctgagtttcctcatctatagatcaacgttatggcgctacgtgatgtccactacttctcctcacttctggacttctttataaatcagattatctgttttgttacttccagggcacaaccataatggcattactgacttccgtgctacatgatgacaragaatttcctaatccaaatatctttgaccctggccactttctagataagaatggcaactttaagaaaagtgactacttcatgcctttctcagcaggtaatagaaactcgtttccattntgtatttaaaggaaagagagaactttttggaattagttggaatttacatggcacctcctctggggctggtagaattgctatttgtccatgatcaagagcaccactcttaacacccatgtgctccaccctcacaatacaccatcattattgggccagatagcggggcttgcaggagttaactctgttgttcccaattgagaaaatgaacatcttggtttgactgaactctgccactagatacatcactaaggcacccaagagctccntcctnagaaggntaaaattcantctgatctttnccttacctgccttgacaaatgtatctaagtccacaactgcattgagtgtcttctacatggtgtctgtcacctcccaggctgag

SEQ ID NO: 53 - DNA, 1001 bp, Homo Sapiens
  allele 501: 12-665-315 : polymorphic base T or C
  misc_binding 502..521: 12-665-315.mis1, potential complement
  misc_binding 482..500: 12-665-315.mis2
  primer_bind 795..815: upstream amplification primer, complement
  primer_bind 357..377: downstream amplification primer
  misc_binding 489..513: 12-665-315 potential probe
  misc_feature 175,181..182,195,215,227,238,245,652,747: n=a, g, c or t
tatcagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcangaaacnntatctcattcccnaaggtaagtttgtttctccntacactgcaacntccatgttttncgaagtnccccaaattcatagtatcatttttaaacctctaccatcaccgggtgagagaagtgcataactcatatgtatggcagtttaactggactttctcttgtttccagtttggggctataaaggtttgtaacaggtcctagtgtctggcagtgtgtgttctccagatttattatctttcttcaagattggtttggctactcttaggtgcttatatttccaaataatttttaaaggtattagtttgtcaatttcccaaaacyttgggctggaatttctggcagggtgacactaaatttataggctagtttggaaagaactgaatcttgacacgttgaggctttccattcctgaatataattatgcttccaatttgtttggggtttcttttatttaaccaggaatgttgtgaantttgttgtcatggctttcgagtctttggttttccctagataattaatatttttgttgtagaacataaatagtttttatcattctgatgatgttanatctgtcaactttgctaaatttactagtcactattcgtaatttatttctggattcattgtaatttctgtgtatattatactgtatctgagttaatattgttttatttcttattttccatttctcatgggcttaatgtctctttatcgcattcattattgcattagctagaatttctaggagagcattgaatagaattggtgacagtggggatccttgtttctcatttctaatctgcaggaagcagtggaagttt

SEQ ID NO: 54 - DNA, 1001 bp, Homo Sapiens
  allele 501: 12-666-324 : polymorphic base A or C
  misc_binding 482..500: 12-666-324.mis1
  misc_binding 502..521: 12-666-324.mis2, potential complement
  primer_bind 186..205: upstream amplification primer
  primer_bind 621..641: downstream amplification primer, complement
  misc_binding 489..513: 12-666-324 potential probe
gcatacttttccatttttaagatccaccataatttatttacaacctccagtaaagttttgtttcaaatcttttatgaataatcataaaataagcattcatatatatagtaattaatatataccttcagtgatatccattaatactcaagaagtgaaactgtttgaaggatggaggtgtttatatacatttctatgaatatcgtcccattggctttaaaagagagtaaacaaattcacacgctcctttatgcccacattcattcattcattaagtagtcattaatttatctagtatctattgagccaatatcttctaaacagtgtttcaggtgtctggaattcattagtgagccaaataaagttctctgctcatataaaacatgtattttagggatgaaacataaacaataaaaataaatgcagagaattagcaaagttgttagccacttctactttccagtcagattgcccttgttcaactgttggctctgacacttaaamagctgtgtgaccttgaacaagatacttaacagatcatcagtgcaattgtttggttgttcaaattggtataataataatatggtaggctaaataatgtcttgacataaagagattaagctggtgggtttcatgtaatcacaagggtctttacattagtgttaaatatagtgaaccccaagtttatcttcaaagaatcagtatgtcagtatgtgcatctatcttattgtttgattctccattttaaagtttaacttcttaattctctttgcccccttgcttccagtttcagtaaacaactttcttaccagtcctaataaatagttcacatctgttcccctggtcacctgctttgaccctagtcacccctggtcacctgctctatcctgactcatcctgagccaccagttctgtaaccgcccttcccaccaaactacttaccccaccactctggctcatactcctgctgttttttaaaagagccaattggaattagcttagac

SEQ ID NO: 55 - DNA, 436 bp, Homo Sapiens
  allele 155: 10-72-155 : polymorphic base A or G
  misc_binding 135..154: 10-72-155.mis1, potential
  misc_binding 156..175: 10-72-155.mis2, potential complement
  primer_bind 1..20: upstream amplification primer
  primer_bind 417..436: downstream amplification primer, complement
  misc_binding 143..167: 10-72-155 potential probe
gtggctgaataaaagcatacaaatacaatgaaaatatcadkctaaatcaggcttagcaaatggacaaaatagtaacttcrtttgctgttawctctrtctactttcctagctctcaaargtctatggccctgtgttcactctgtattttggcctgraacccatrgtggtgctgcatggatatgaaghrgtgaaggaagccctgattgatcttggagaggagttttctggaagaggcawtttcccactggctgaaagagctaacagaggatttggtaggtgtgcawgtgcctgtttcagcatctgtcttggggatggggaggatggaaaacagagacttdcagagctcctcgggcagagcttggcccatccacatggctgcccagtgtcagcttcctctttcttgcctgggtctccctcctagtttcgtttctcttcc

SEQ ID NO: 56 - DNA, 678 bp, Homo Sapiens
  allele 178: 10-76-177 : polymorphic base A or T
  misc_binding 158..177: 10-76-177.mis1, potential
  misc_binding 179..198: 10-76-177.mis2, potential complement
  primer_bind 1..18: upstream amplification primer
  primer_bind 416..435: downstream amplification primer, complement
  misc_binding 166..190: 10-76-177 potential probe
  misc_feature 549,635,642,655,661: n=a, g, c or t
ttacgcatgaggagtaactgctctctgtgtttgctattttcaggaaaacggatttgtgtggggagaagccctggccggcatggagctgtttttattcctgacctccattttacagaactttaacctgaaatctctggttgacccaaagaaccttgacaccactccagttgtcaatggwtttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcnttttctgcatgttctaaataaaaagcattattatttgctgagtcagtttattagaccttccttcttttatgcataatgtaggtcangaaattnaaagaaaatagangttccnaggaggccatgctggtt

SEQ ID NO: 57 - DNA, 718 bp, Homo Sapiens
  allele 218: 10-76-217 : polymorphic base C or T
  misc_binding 198..217: 10-76-217.mis1, potential
  misc_binding 219..238: 10-76-217.mis2, potential complement
  primer_bind 1..18: upstream amplification primer
  primer_bind 416..435: downstream amplification primer, complement
  misc_binding 206..230: 10-76-217 potential probe
  misc_feature 549,635,642,655,661,708: n=a, g, c or t
ttacgcatgaggagtaactgctctctgtgtttgctattttcaggaaaacggatttgtgtggggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattyctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcnttttctgcatgttctaaataaaaagcattattatttgctgagtcagtttattagaccttccttcttttatgcataatgtaggtcangaaattnaaagaaaatagangttccnaggaggccatgctggttctcaaaatgataaggacagaaaggacaaangaggaagagg

SEQ ID NO: 58 - DNA, 834 bp, Homo Sapiens
  allele 334: 10-76-333 : polymorphic base G or C
  misc_binding 315..333: 10-76-333.mis1
  misc_binding 335..354: 10-76-333.mis2, potential complement
  primer_bind 1..18: upstream amplification primer
  primer_bind 416..435: downstream amplification primer, complement
  misc_binding 322..346: 10-76-333 potential probe
  misc_feature 549,635,642,655,661,708,751: n=a, g, c or t
ttacgcatgaggagtaactgctctctgtgtttgctattttcaggaaaacggatttgtgtggggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctsacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcnttttctgcatgttctaaataaaaagcattattatttgctgagtcagtttattagaccttccttcttttatgcataatgtaggtcangaaattnaaagaaaatagangttccnaggaggccatgctggttctcaaaatgataaggacagaaaggacaaangaggaagagggtagggaagctattttgggtgagtgttagagtntacttgaggattggatttgaaagtgagaaactgtgtccaggggcagctctaacctctagggaaatattcagaggatcagtcaa

SEQ ID NO: 59 - DNA, 995 bp, Homo Sapiens
  allele 501: 10-77-316 : polymorphic base A or T
  misc_binding 481..500: 10-77-316.mis1, potential
  misc_binding 502..521: 10-77-316.mis2, potential complement
  primer_bind 185..203: upstream amplification primer
  primer_bind 593..610: downstream amplification primer, complement
  misc_binding 489..513: 10-77-316 potential probe
  misc_feature 427,513,520,533,539,586,629,762..765,774..776,813: n=a, g, c or t
acctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcnttttctgcatgttctaaataaaaagcattattatttgctgagtcagtttattagaccttccttcttttatgcawaatgtaggtcangaaattnaaagaaaatagangttccnaggaggccatgctggttctcaaaatgataaggacagaaaggacaaangaggaagagggtagggaagctattttgggtgagtgttagagtntacttgaggattggatttgaaagtgagaaactgtgtccaggggcagctctaacctctagggaaatattcagaggatcagtcaaagggtggaatggacattaaatgctagaattcttatatccacattggtgtnnnntcctttttnnnacaaagtcttgctctgtcacccaggctggagtgcagnggtgtgatctcagctctctataacctccgcctcccaggttcaagtgattctcctgcctcagcctcctgagtagctgggattacaggtgcatgccaccacacctggctaattttttgtatttttagtacagacgggttttcaccgtgttagccaggatggtcttaatctcctgaccttgtgat

SEQ ID NO: 60 - DNA, 442 bp, Homo Sapiens
  allele 78: 10-155-78 : polymorphic base C or T
  misc_binding 58..77: 10-155-78.mis1, potential
  misc_binding 79..98: 10-155-78.mis2, potential complement
  primer_bind 1..18: upstream amplification primer
  primer_bind 424..442: downstream amplification primer, complement
  misc_binding 66..90: 10-155-78 potential probe
accgagcttattttacccaaaataaggtagtatatttctgttagagtttagagtttcatgagtcagggaccaagttaytgcttttctttgccctgtataaaggcttctccaaggcctttgacttacctaagtactaaatgttataaaaccaaactcttctgacctctcaatctagtcaactggggctgtaattattaatgaaattaatgtttattttgaaaataatttactagactgaattacgaaatcctgaatcattgtacactatcagtaaatattggtggacccaactgaactgaatgttttgcttgaaatgaaacctttgagatgcagggcttatgggttctagtcccagctctagcactagcagacagcatgttcttggctaagatactgaatcttcaaggctcagcttcctcattccggaaatgggtcaatttta

SEQ ID NO: 61 - DNA, 442 bp, Homo Sapiens
  allele 104: 10-155-104 : polymorphic base G or C
  misc_binding 84..103: 10-155-104.mis1, potential
  misc_binding 105..124: 10-155-104.mis2, potential complement
  primer_bind 1..18: upstream amplification primer
  primer_bind 424..442: downstream amplification primer, complement
  misc_binding 92..116: 10-155-104 potential probe
accgagcttattttacccaaaataaggtagtatatttctgttagagtttagagtttcatgagtcagggaccaagttattgcttttctttgccctgtataaaggsttctccaaggcctttgacttacctaagtactaaatgttataaaaccaaactcttctgacctctcaatctagtcaactggggctgtaattattaatgaaattaatgtttattttgaaaataatttactagactgaattacgaaatcctgaatcattgtacactatcagtaaatattggtggacccaactgaactgaatgttttgcttgaaatgaaacctttgagatgcagggcttatgggttctagtcccagctctagcactagcagacagcatgttcttggctaagatactgaatcttcaaggctcagcttcctcattccggaaatgggtcaatttta

SEQ ID NO: 62 - DNA, 772 bp, Homo Sapiens
  allele 52: 10-156-52 : polymorphic base A or G
  misc_binding 32..51: 10-156-52.mis1, potential
  misc_binding 53..71: 10-156-52.mis2, complement
  primer_bind 1..19: upstream amplification primer
  primer_bind 401..420: downstream amplification primer, complement
  misc_binding 40..64: 10-156-52 potential probe
ttcaaggctcagcytcctcattccggaaatgggtcaattttattgtaagcaraggtaattgagagattcaaaagggacatgaggtgtaacaattctctgtaaattgttagaatccctgttaaaaatgaccagtaaagctttgtgcaactgtgtcttgacataactttatttttcttaataaaagaaatggaaataacctcactagggaatttagaacaaatatgatgatatctttaaagaaaatggctttgcacaagtattgacattaatgatctagtaaagtgtatctttctagttgtatttagatcctcaactcagtatgtcagctcctgttaaggtctatacattgtggtggttctgtgctgtgggtccatttagtgatttccctacctcccatcttctattgcatccacaactgtggttctgtccataatttcctttgctttctgtgcattattacatcatatctgaaaatgagaaaccaaaaacaatagaaagcagccatgtctggaggtgactggggggtcgagaagccctagtttctcaaacccttagcaccaaatttttccctcagttacactgagcgtttcacttctgcagtgatggagaagggagatcccttatttcttctcatgagcatctctggtgctgtttcccttagagacaaataaggggttctatttaatgtgaagcctgttttatgaacagaataaatgtggtgtatattcagaataactaatgtttggaagtttgttttattttgctaaaattg

SEQ ID NO: 63 - DNA, 431 bp, Homo Sapiens
  allele 39: 10-157-39 : polymorphic base C or T
  misc_binding 20..38: 10-157-39.mis1
  misc_binding 40..59: 10-157-39.mis2, potential complement
  primer_bind 1..18: upstream amplification primer
  primer_bind 412..431: downstream amplification primer, complement
  misc_binding 27..51: 10-157-39 potential probe
ctgtgggkccatttagtgatttccctacctcccatcttytattgcatccacaactgtggttctgtccataatttcctttgctttctgtgcattattacatcatatctgaaaatgagaaaccaaaaacaatagaaagcagccatgtctggaggtgactggggggtcgagaagccctagtttctcaaacccttagcaccaaatttttccctcagttacactgagcgtttcacttctgcagtgatggagaagggagatcccttatttcttctcatgagcatctctggtgctgtttcccttagagacaaataaggggttctatttaatgtgaagcctgttttatgaacagaataaatgtggtgtatattcagaataactaatgtttggaagtttgttttattttgctwaaaattggttctcaaggcagctctggt

SEQ ID NO: 64 - DNA, 431 bp, Homo Sapiens
  allele 131: 10-157-131 : polymorphic base A or G
  misc_binding 111..130: 10-157-131.mis1, potential
  misc_binding 132..150: 10-157-131.mis2, complement
  primer_bind 1..18: upstream amplification primer
  primer_bind 412..431: downstream amplification primer, complement
  misc_binding 119..143: 10-157-131 potential probe
ctgtgggkccatttagtgatttccctacctcccatcttytattgcatccacaactgtggttctgtccataatttcctttgctttctgtgcattattacatcatatctgaaaatgagaaaccaaaaacaatrgaaagcagccatgtctggaggtgactggggggtcgagaagccctagtttctcaaacccttagcaccaaatttttccctcagttacactgagcgtttcacttctgcagtgatggagaagggagatcccttatttcttctcatgagcatctctggtgctgtttcccttagagacaaataaggggttctatttaatgtgaagcctgttttatgaacagaataaatgtggtgtatattcagaataactaatgtttggaagtttgttttattttgctwaaaattggttctcaaggcagctctggt

SEQ ID NO: 65 - DNA, 431 bp, Homo Sapiens
  allele 166: 10-157-166 : polymorphic base A or G
  misc_binding 146..165: 10-157-166.mis1, potential
  misc_binding 167..186: 10-157-166.mis2, potential complement
  primer_bind 1..18: upstream amplification primer
  primer_bind 412..431: downstream amplification primer, complement
  misc_binding 154..178: 10-157-166 potential probe
ctgtgggkccatttagtgatttccctacctcccatcttytattgcatccacaactgtggttctgtccataatttcctttgctttctgtgcattattacatcatatctgaaaatgagaaaccaaaaacaatagaaagcagccatgtctggaggtgactggggggtcragaagccctagtttctcaaacccttagcaccaaatttttccctcagttacactgagcgtttcacttctgcagtgatggagaagggagatcccttatttcttctcatgagcatctctggtgctgtttcccttagagacaaataaggggttctatttaatgtgaagcctgttttatgaacagaataaatgtggtgtatattcagaataactaatgtttggaagtttgttttattttgctwaaaattggttctcaaggcagctctggt

SEQ ID NO: 66 - DNA, 431 bp, Homo Sapiens
  allele 246: 10-157-246 : polymorphic base A or G
  misc_binding 226..245: 10-157-246.mis1, potential
  misc_binding 247..266: 10-157-246.mis2, potential complement
  primer_bind 1..18: upstream amplification primer
  primer_bind 412..431: downstream amplification primer, complement
  misc_binding 234..258: 10-157-246 potential probe
ctgtgggkccatttagtgatttccctacctcccatcttytattgcatccacaactgtggttctgtccataatttcctttgctttctgtgcattattacatcatatctgaaaatgagaaaccaaaaacaatagaaagcagccatgtctggaggtgactggggggtcgagaagccctagtttctcaaacccttagcaccaaatttttccctcagttacactgagcgtttcacttctgcagtgatggaraagggagatcccttatttcttctcatgagcatctctggtgctgtttcccttagagacaaataaggggttctatttaatgtgaagcctgttttatgaacagaataaatgtggtgtatattcagaataactaatgtttggaagtttgttttattttgctwaaaattggttctcaaggcagctctggt

SEQ ID NO: 67 - DNA, 581 bp, Homo Sapiens
  allele 161: 10-159-161 : polymorphic base A or T
  misc_binding 142..160: 10-159-161.mis1
  misc_binding 162..181: 10-159-161.mis2, potential complement
  primer_bind 1..19: upstream amplification primer
  primer_bind 403..422: downstream amplification primer, complement
  misc_binding 149..173: 10-159-161 potential probe
aggaattttttttagggggtttaatggtaaaggtgtttatatctgctaaggtaatttacttgatatatgtttggttatttaagatatatgagttatgttagctatttcatgtttaggctgctgtatttttagtaggctatattaaatatttgaaaggattwcattataaagaacaaagtctcctaatctttgatatagcattgacatactttttaaatatacaaggcatagaatatggccatttctgttaaatcatatattcccaactggttattaatctaagaattcagaattttgagtaattgcttttgcatcagattatttacttcagtgctctcaattatgatggtgcattagaaccatctgggttaacatttgttttttattaccaatacctaggctccaaccaagtacagtgaaactggaatgtacagagtggacaatggaacgaaggagaacaagaccaaaggacattttatttttatctgtatcagtgggtcaaagtcctttcagaaggagcatatagtggacctaggtgattggtcrmtttatccatcaaagaggcacacaccgaattagca

SEQ ID NO: 68 - DNA, 581 bp, Homo Sapiens
  allele 162: 10-159-162 : polymorphic base A or C
  misc_binding 142..161: 10-159-162.mis1, potential
  misc_binding 163..182: 10-159-162.mis2, potential complement
  primer_bind 1..19: upstream amplification primer
  primer_bind 403..422: downstream amplification primer, complement
  misc_binding 150..174: 10-159-162 potential probe
aggaattttttttagggggtttaatggtaaaggtgtttatatctgctaaggtaatttacttgatatatgtttggttatttaagatatatgagttatgttagctatttcatgtttaggctgctgtatttttagtaggctatattaaatatttgaaaggatttmattataaagaacaaagtctcctaatctttgatatagcattgacatactttttaaatatacaaggcatagaatatggccatttctgttaaatcatatattcccaactggttattaatctaagaattcagaattttgagtaattgcttttgcatcagattatttacttcagtgctctcaattatgatggtgcattagaaccatctgggttaacatttgttttttattaccaatacctaggctccaaccaagtacagtgaaactggaatgtacagagtggacaatggaacgaaggagaacaagaccaaaggacattttatttttatctgtatcagtgggtcaaagtcctttcagaaggagcatatagtggacctaggtgattggtcrmtttatccatcaaagaggcacacaccgaattagca

SEQ ID NO: 69 - DNA, 353 bp, Homo Sapiens
  allele 169: 10-83-169 : polymorphic base C or T
  misc_binding 150..168: 10-83-169.mis1
  misc_binding 170..189: 10-83-169.mis2, potential complement
  primer_bind 1..19: upstream amplification primer
  primer_bind 336..353: downstream amplification primer, complement
  misc_binding 157..181: 10-83-169 potential probe
aagtcatactgcttcttactaggtctgtctgggtgggaatgtaacttctttggacctcaattttcttatctattgataaaagagattggactaggtgatttccatcacttcttcccactctttgacttctttataacttagtttgtctgttttgctattttcagggcaygaccataataacatccctgacttctgtgctgcacaatgacaaagaattccccaacccagagatgtttgaccctggccactttctggataagagtggcaactttaagaaaagtgactacttcatgcctttctcagcaggtaatagatattcatttccatctgtccttcagggcacatgatacctt

SEQ ID NO: 70 - DNA, 425 bp, Homo Sapiens
  allele 152: 10-84-152 : polymorphic base C or T
  misc_binding 132..151: 10-84-152.mis1, potential
  misc_binding 153..172: 10-84-152.mis2, potential complement
  primer_bind 1..18: upstream amplification primer
  primer_bind 406..425: downstream amplification primer, complement
  misc_binding 140..164: 10-84-152 potential probe
  misc_feature 413: n=a, g, c or t
gaacaaatcccctatgtctcttattttcaggaaaacggatgtgtatgggagagggcctggcccgcatggagctgtttttattcctgaccaccattttgcagaactttaacctgaaatctcaggttgacccaaaggatattgacatcaccccyattgccaatgcatttggtcgtgtgccacccttgtaccagctctgcttcattcctgtctgaagaagggcagatagtttggctgctcctgtgctgtcacctgcaattctcccttatcagggccattggcctctcccttctctctgtgagggatattttctctgacttgtcaatccacatcttcccattccctcaagatccaatgaacatccaacctccattaaagagagtttcttgggtcacttcctaaatatatctgctatnctccatactctg

SEQ ID NO: 71 - DNA, 425 bp, Homo Sapiens
  allele 243: 10-84-243 : polymorphic base C or T
  misc_binding 224..242: 10-84-243.mis1
  misc_binding 244..263: 10-84-243.mis2, potential complement
  primer_bind 1..18: upstream amplification primer
  primer_bind 406..425: downstream amplification primer, complement
  misc_binding 231..255: 10-84-243 potential probe
  misc_feature 413: n=a, g, c or t
gaacaaatcccctatgtctcttattttcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgytgtcacctgcaattctcccttatcagggccattggcctctcccttctctctgtgagggatattttctctgacttgtcaatccacatcttcccattccctcaagatccaatgaacatccaacctccattaaagagagtttcttgggtcacttcctaaatatatctgctatnctccatactctg

SEQ ID NO: 72 - DNA, 425 bp, Homo Sapiens
  allele 277: 10-84-277 : polymorphic base A or G
  misc_binding 257..276: 10-84-277.mis1, potential
  misc_binding 278..297: 10-84-277.mis2, potential complement
  primer_bind 1..18: upstream amplification primer
  primer_bind 406..425: downstream amplification primer, complement
  misc_binding 265..289: 10-84-277 potential probe
  misc_feature 413: n=a, g, c or t
gaacaaatcccctatgtctcttattttcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgctgtcacctgcaattctcccttatcagggccattrgcctctcccttctctctgtgagggatattttctctgacttgtcaatccacatcttcccattccctcaagatccaatgaacatccaacctccattaaagagagtttcttgggtcacttcctaaatatatctgctatnctccatactctg

SEQ ID NO: 73 - DNA, 425 bp, Homo Sapiens
  allele 295: 10-84-295 : polymorphic base A or G
  misc_binding 275..294: 10-84-295.mis1, potential
  misc_binding 296..314: 10-84-295.mis2, complement
  primer_bind 1..18: upstream amplification primer
  primer_bind 406..425: downstream amplification primer, complement
  misc_binding 283..307: 10-84-295 potential probe
  misc_feature 413: n=a, g, c or t
gaacaaatcccctatgtctcttattttcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgctgtcacctgcaattctcccttatcagggccattggcctctcccttctctctrtgagggatattttctctgacttgtcaatccacatcttcccattccctcaagatccaatgaacatccaacctccattaaagagagtttcttgggtcacttcctaaatatatctgctatnctccatactctg

SEQ ID NO: 74 - DNA, 424 bp, Homo Sapiens
  allele 43: 10-85-43 : polymorphic base C or T
  misc_binding 24..42: 10-85-43.mis1
  misc_binding 44..63: 10-85-43.mis2, potential complement
  primer_bind 1..18: upstream amplification primer
  primer_bind 405..424: downstream amplification primer, complement
  misc_binding 31..55: 10-85-43 potential probe
gtttcttgggtcacttcctaaatatatctgctattctccataytctgtatcacttgtattgaccaccacatatgctaatacctatctactgctgagttgtcagtatgttatcactagaaaacaaagaaaaatgattaataaatgacaattcagagccatttattctctgcatgctctagataaaaatgattattatttactgggtcagttcttagatttctttcttttgagtaaaatgaaagtaagaaatgaaagaaaatagaatgtgaagaggctgtgctggccctcatagtgttaagcacaaaaagggagaaaggtaagagggtaggaaagctgttttagctaaatgccacctagagttattggaggtctgaatttggaaaaaaaaactatgtccaggagcagctgtaacvtgtagggaaat

SEQ ID NO: 75 - DNA, 424 bp, Homo Sapiens
  allele 117: 10-85-117 : polymorphic base G or T
  misc_binding 97..116: 10-85-117.mis1, potential
  misc_binding 118..136: 10-85-117.mis2, complement
  primer_bind 1..18: upstream amplification primer
  primer_bind 405..424: downstream amplification primer, complement
  misc_binding 105..129: 10-85-117 potential probe
gtttcttgggtcacttcctaaatatatctgctattctccatactctgtatcacttgtattgaccaccacatatgctaatacctatctactgctgagttgtcagtatgttatcactakaaaacaaagaaaaatgattaataaatgacaattcagagccatttattctctgcatgctctagataaaaatgattattatttactgggtcagttcttagatttctttcttttgagtaaaatgaaagtaagaaatgaaagaaaatagaatgtgaagaggctgtgctggccctcatagtgttaagcacaaaaagggagaaaggtaagagggtaggaaagctgttttagctaaatgccacctagagttattggaggtctgaatttggaaaaaaaaactatgtccaggagcagctgtaacvtgtagggaaat

SEQ ID NO: 76 - DNA, 424 bp, Homo Sapiens
  allele 320: 10-85-320 : polymorphic base A or T
  misc_binding 300..319: 10-85-320.mis1, potential
  misc_binding 321..340: 10-85-320.mis2, potential complement
  primer_bind 1..18: upstream amplification primer
  primer_bind 405..424: downstream amplification primer, complement
  misc_binding 308..332: 10-85-320 potential probe
gtttcttgggtcacttcctaaatatatctgctattctccatactctgtatcacttgtattgaccaccacatatgctaatacctatctactgctgagttgtcagtatgttatcactagaaaacaaagaaaaatgattaataaatgacaattcagagccatttattctctgcatgctctagataaaaatgattattatttactgggtcagttcttagatttctttcttttgagtaaaatgaaagtaagaaatgaaagaaaatagaatgtgaagaggctgtgctggccctcatagtgttaagcacaaaaagggagaaaggtawgagggtaggaaagctgttttagctaaatgccacctagagttattggaggtctgaatttggaaaaaaaaactatgtccaggagcagctgtaacvtgtagggaaat

SEQ ID NO: 77 - DNA, 352 bp, Homo Sapiens
  allele 121: 10-86-121 : polymorphic base A or C
  misc_binding 102..120: 10-86-121.mis1
  misc_binding 122..141: 10-86-121.mis2, potential complement
  primer_bind 1..18: upstream amplification primer
  primer_bind 334..352: downstream amplification primer, complement
  misc_binding 109..133: 10-86-121 potential probe
aagggagaaaggthagagggtaggaaagctgttttagctaaatgccacctagagttattggaggtctgaatttggaaaaaaaaactatgtccaggagcagctgtaacctgtagggaaatamtggaacaatcatccataagagggatgaacattaagtgtttgaattcatgctctgcttttgtgttactgtaaacacaagatcaagatttggataatctttttcctttgtgtttccaacttagatcatgtctaaatatatgctttcatatggctaatcatgtgttaatgactgttatttttctcttccaaacaagagcaaaatctccagaaatcctcaccaggctttattttt

SEQ ID NO: 78 - DNA, 1001 bp, Homo Sapiens
  allele 501: 12-244-275 : polymorphic base A or G
  misc_binding 481..500: 12-244-275.mis1, potential
  misc_binding 502..521: 12-244-275.mis2, potential complement
  primer_bind 228..247: upstream amplification primer
  primer_bind 660..678: downstream amplification primer, complement
  misc_binding 489..513: 12-244-275 potential probe
atcacgttctgtccagtgtctgcctattcccttcttctttttttcttcccttgatgcccttttatcacatgcattgtctcagacccttcgaatatgtgctcataaatgcatggcatcatctccttcccacatcgattcactttcaattaaaagccaaaactctttcatttcaactttggatttaacatgcttttgaaagaagggttgagaaatatagagaaacagattgggaaaccatgctctgctgtttcttttttttaaactttctatgtaagtgtggaatttttcattctgttttattattaactttaagccaagactttttaatagaaggatatataaatacatctttgtctatacatttctgctgaatttgaagaaatgctgaatattcttaaaccattgtgttccctggtgggctgatggactgtgattttataaggtggcctcagccaactgcagcagctgttccctgtcagaggggctagaggtttggcaagrgcggtggaagaggtgcagtggtgtgttcgttcactagaagcatcagggagaaggttttgcctgtttgtatttcatcttctctcatcaagtcctcagaaaccacagtgctgtctgcagggtgctgtggatctggcatggcccatacaggcaacatgactgagtagaaaggacacacagctctggatgtccttgggccccacagcaactgcccttgaaacatttagtccttgtgagcatttgatgatttacttgccttcaattttccatggacctaatactctttataaagggaaatattttaaacctatgaaacattgtggagaatggcatgggaaatacccatgtatgcaccacccagcttaacaaatgctctcctgtcatttctaaccacaatctctttgaagagctcttttgtctttcaatctctcttccctgtttggcccacattacccttcatcgtatgaagacttggatggctcctgtgtcagactcttgctgtg

SEQ ID NO: 79 - DNA, 950 bp, Homo Sapiens
  allele 450: 12-251-153 : polymorphic base A or C
  misc_binding 431..449: 12-251-153.mis1
  misc_binding 451..470: 12-251-153.mis2, potential complement
  primer_bind 298..318: upstream amplification primer
  primer_bind 806..826: downstream amplification primer, complement
  misc_binding 438..462: 12-251-153 potential probe
  misc_feature 52,54,100: n=a, g, c or t
taggaagctgagagaaaaggatcttctcccctgtgcacaggagccaggaatnanttatctgttacattgtccccttggatattccaaaagaataatacantgtgtagaaagaaaaaataaaaacctgattgtactaaagttttgagcatagacgttatggagtggtgggaggggaaggtgtttgatagctgttggctggcagtgactggggcaggaaagttacaatgaggaagttggaataacttcaatcccttcattattttgctgaggataccaccaaaatatgaaatattaaaccttcccaccacttctaatttcttttctccaatcttaaattttaaaagactctgtaaaggctataggtagggcaatgctattgtttgttgtctgaactggaatgtaatttgaattatgctggaacaacatgtgtaagctgagcctgtcctgggmagactggggacatgtggtcactcagctatgggatgccccgatcaactttggagtgatctatttgtttaatcaatatcactgttagttcttacttttacaaaaataatctgccctcagagcaacctcagatcccaggagttggggaaaagcaggtgtttcaggaggcttatcagggagtgcagcggagacatgacgttcacagcaagtctgaacagggtgtggctgttctataaagtgctgaagagacatcagctctgggcgtagactgtggggtctggcaatgtcaaatttattgattggccgagaaagagttaattattttattcttgtcctgcagaagcacagtgttgacacaccttttaccatccacactcaacacaaactactgtaattgtctgattattgggtctgtgtctccctatgactgaggtccttgagctcagaggtgggtctaactcaccttagtgtctccatcactcccagcacagggccagctgcat

SEQ ID NO: 80 - DNA, 746 bp, Homo Sapiens
  allele 246: 12-254-115 : polymorphic base A or T
  misc_binding 226..245: 12-254-115.mis1, potential
  misc_binding 247..266: 12-254-115.mis2, potential complement
  primer_bind 132..152: upstream amplification primer
  primer_bind 586..603: downstream amplification primer, complement
  misc_binding 234..258: 12-254-115 potential probe
ctgccacaatctcctgagtccagacaatctagagcagaagggtagactgaggaaaatatacacagtataaaaaagtaacaaaatcaaaacctgaaacaaagatcaacatccaataaatgcttctgaataaagggagagtagataagaactggattttaatcccaacactgccatttaccagctggccaatactgagctagttactctaaagagttcagttttctcatttgtacaaataggatttgwctttccatctcactgagttgtgatgagagtcatatgcaacagcatatgaagaggctagcaaaaggtatttaacaagcgttcaacattctcatgatgacatgaataacactgtacatacaacataccaacttgataaatacacagcacagttaatagctgagggcagagttatggttgggaagagagagagtgcaacataggcagagtgaggggggattcccacaattttctaagacagaaaagtgggggaatcagtagttactggaaagaataggcaatgcctgactggatagaaaaagattctatgcctttgtcaaatttcacaaaagtgacttaagcctatactgcgggatgttcacactacgtccctttagtgcagttacggtacttcaggctgcaagtaaccaaatacaactaaaattgtcttatacaataagggcgtaattatctcatataacaagaagcttggcatgaaggaaatttcaacaatttcacaacgg

SEQ ID NO: 81 - DNA, 811 bp, Homo Sapiens
  allele 311: 12-254-180 : polymorphic base A or G
  misc_binding 292..310: 12-254-180.mis1
  misc_binding 312..331: 12-254-180.mis2, potential complement
  primer_bind 132..152: upstream amplification primer
  primer_bind 586..603: downstream amplification primer, complement
  misc_binding 299..323: 12-254-180 potential probe
ctgccacaatctcctgagtccagacaatctagagcagaagggtagactgaggaaaatatacacagtataaaaaagtaacaaaatcaaaacctgaaacaaagatcaacatccaataaatgcttctgaataaagggagagtagataagaactggattttaatcccaacactgccatttaccagctggccaatactgagctagttactctaaagagttcagttttctcatttgtacaaataggatttgtctttccatctcactgagttgtgatgagagtcatatgcaacagcatatgaagaggctagcaaaagrtatttaacaagcgttcaacattctcatgatgacatgaataacactgtacatacaacataccaacttgataaatacacagcacagttaatagctgagggcagagttatggttgggaagagagagagtgcaacataggcagagtgaggggggattcccacaattttctaagacagaaaagtgggggaatcagtagttactggaaagaataggcaatgcctgactggatagaaaaagattctatgcctttgtcaaatttcacaaaagtgacttaagcctatactgcgggatgttcacactacgtccctttagtgcagttacggtacttcaggctgcaagtaaccaaatacaactaaaattgtcttatacaataagggcgtaattatctcatataacaagaagcttggcatgaaggaaatttcaacaatttcacaacggcaacaaaaactctgtttcttctacctttccaccattcctgtgttctcagttccaatatggctgct

SEQ ID NO: 82 - DNA, 999 bp, Homo Sapiens
  allele 499: 12-265-300 : polymorphic base T or C
  misc_binding 479..498: 12-265-300.mis1, potential
  misc_binding 500..519: 12-265-300.mis2, potential complement
  primer_bind 779..798: upstream amplification primer, complement
  primer_bind 308..328: downstream amplification primer
  misc_binding 487..511: 12-265-300 potential probe
  misc_feature 427,494,669..670,679,772,874,944: n=a, g, c or t
taataatgtgttttggggtaagcctactcatattctcaacctgtctgcagtagtcgttagaatctgaacttcctgaagttcatgtgcaaagttgagttaattgtttaatattcaacaaggattatgccagtaagatggtaggaaaatattagatatgtgtcatcactgctggtattatttaaactgcaacatattttagctggctgctgatctcagccaccatgcctgcattttatctctgtctcgtggtctgcaaccttggaagctttgaacttagctcatagaatcctgggcatcaagaacatgtggttctaatggctagatagggaatgagagtaaaaggattttgcccacggtcacgtgagtaaacaacagatttggaggggtctggactactgtgatgacttcattctgacaatatgttccnagttgtcctttcatttcctcctaatcacatgtctggtctgatctggctgtttcccaccttccaattncctgycttctccaatgctcccttccgtaggtcactctgtggctcagagaccctgcttagcaagcgcccaacctttcaattatttgttcagtaaaacttgaactcatgtctccccttcttgataaaaagaaaatacgttatgtaatgtcgggttactctataactcttgtcctgtnnctctcggcnaactactgaactaactgttttcatattgagcaaacgtttatggaaggactgccaagagtcaggtactaggcttggtaatattccccgttctcntctagtcaaagccaacaccagccagacttgcagatctaggtcccaagcccactgcagatcacaggccagggtctggtctcctctgagctcctttgggagggnaaagacagaattattaacacccattttgtagattaggcaactgaggctgaggaagtttaaataactcagnacagggcctgcacgtcagtcatattccaaggatccctactcactgtcttctctct

SEQ ID NO: 83 - DNA, 1001 bp, Homo Sapiens
  allele 501: 12-271-118 : polymorphic base T or C
  misc_binding 481..500: 12-271-118.mis1, potential
  misc_binding 502..521: 12-271-118.mis2, potential complement
  primer_bind 598..618: upstream amplification primer, complement
  primer_bind 122..141: downstream amplification primer
  misc_binding 489..513: 12-271-118 potential probe
  misc_feature 205,525,542,571,657: n=a, g, c or t
gactgagtccgaaaaggagtctgcaaagggagataggggtgggtcagttttataggactggggtaagcagtggaaagttgcagttaaaggaagttatctattgtcagcagaggagggggtcacaaggtgcatggtagggagatcataagactcattgtccagaagaagaatgtcacgaggtcgatcaatcgatcagttggggcangggcagtaacaagtcataatggaacgttgtaaggttggtcaatcagttaagacaggagctggctgtttcacctatttgtagtttttggttgcctcaggccatctggatgtacccatgcaggcttgggctaagaggcctgaaacccaccactttcccatgtcaaatctttagtagatgtacccccaagatacacattcctcggaccttcttttccatagttaaaacttcacccctgaaatgtagaaacaggaaggttttttttttaagtttcagtgcaaactcggagcaagtgtcayaattttctgtctccgatgtgtagnaggtgacattttctcangaactttcacgttaagctggaaaactggnaaagcgagtccactttgtcattctgtcactcactcattttctcactcaacaaacatgcctcacacttatctaaatctgctagactnaaaagaggtccctggtgtctgtaactttctaattctgctagaattctagagtgagctcatgaaataaatgaaaaggatgaagaacaaagagaaaaaagactgcacgttcccttctggcgctcactcacattccctcagcctcagtttctccacatgcccctagaggtgatcattcaaggatttatgagattttagagacaacacatgaaaaagcaaagagacatcagaaagacaaggagttacttagtatttatacacaaggataagacattcagtatcgacaacacttaaagaaaattcaagagtgattttaaatttcccatttcaaatacctcctctatttt

SEQ ID NO: 84 - DNA, 1001 bp, Homo Sapiens
  allele 501: 12-272-112 : polymorphic base A or C
  misc_binding 482..500: 12-272-112.mis1
  misc_binding 502..521: 12-272-112.mis2, potential complement
  primer_bind 390..409: upstream amplification primer
  primer_bind 768..788: downstream amplification primer, complement
  misc_binding 489..513: 12-272-112 potential probe
aagaggggcccaacttgtaatcataggagcttatgctattttaatgccatccatcagactacaatcaattaccactcatctagctttttgtccatctctcattcttgtacatcctgagatagtcaattctgagaactgtagcctagatctatcacctgatgcctctcaaagatataatccgtgcttctcaagctaggctatgcacacaaatcactgcatcttgtgaaagttcagattttgaatcagtagttcaagggtggggtttgagattttgcatttctaatgagctctcagatgcttctgacccatggaccacactttgaataccaagaagtggtctgtagaccaatattggtcccttaagttccctcaaacatatcttcgggaaacgtcctttgattttccctacatttaaccattagtgttgcaaattctctcaaagtttgtcaagatatattgtagctaaaataaattacatttttcttgggggagagtactacmtcatattaacttacaataaagtacttttaggatcattcaaggaacacacccataacactgagtatgttatgcggaaatgctctctctggaaattacacagctgtgcaggtggcgggggtggcatgaggaggagtggatggcccacattctcgaagaccttggggaaaactggattaaaatgatttgccttattctggttctgtaagatacacatcagaatgaaaccacccccagtgtacctctgaattgcttttctattcttttcccttagggatttgagggcttcacttagatttctcttcatctaaactgtgatgccctacattgatctgatttacctaaaatgtctttcctctcctttcagctctgtccgatctggagctcgtggcccaatcaattatctttatttttgctggctatgaaaccacgagcagtgttctctccttcattatgtatgaactggccactcaccctgatgtccagcagaaactgcaggagga

SEQ ID NO: 85 - DNA, 1001 bp, Homo Sapiens
  allele 503: 10-216-182 : polymorphic base A or G
  misc_binding 483..502: 10-216-182.mis1, potential
  misc_binding 504..522: 10-216-182.mis2, complement
  primer_bind 323..339: upstream amplification primer
  primer_bind 800..819: downstream amplification primer, complement
  misc_binding 491..515: 10-216-182 potential probe
  misc_feature 76,80,96,319,399,556,578,667,676,731,752,759,914,933: n=a, g, c or t
tgctatccttcccccctctccccaccccacaacaggccccagtgtgtgatgttccccttcctgtgtccatgtgttnctcnattgtatatttttttnaaatctaccacatcaaggcacctctttttcatgttgcccatggtttaggtgaacataaagacagagctcgtctgaggcaacatacagtccaacaaagccacctgcctctctgtctccactctctctctacactgcacgcgtgctaggtgttgatcctgtctattccagtggaagaacaggttccgtaccatgtggagaatttgcatgtaaaaggagactgggnatatacaggctggagaccacatcaggtggctgggcatgtgggataaatcctattgagcatctgtcatagggcctgtcacnttagtagacagtcactaaatatttgttaaatacatgatgcctgtttaacacattttctacaaccatggagacctccacaactgatgtaggacaaaatctttctrctttgaactctagcctttcgggccagtgggatttatgaaaaatgccatctctnatagctgaggatgaagaatggnaagagaatacgatcattgctgtctccaacattcaccagcggaaaactcaaggaggtatgaaaataacttgggttttaattagaaacttnaaagaatgnaatcaggtggggacaggtagaaagtaagatcagagttcctttccgaggagtagtnctgctgaatttgagcttcctnaaaaatnagtctttttatgtacagaaaacacatcataaaattcattacacaatgtcacttattgttccatgccaggcaaagtcatgtccttctgggacttatgtctgcacatttaactatgggtggtgttgtgttttgtgcttagatggtccctatcattgncccagtatggagatgtgtntggtgagaaatctgaggcgggaagcagagacaggcaagcctgtcaccttgaaacagtaagtaggagca

SEQ ID NO: 86 - DNA, 1001 bp, Homo Sapiens
  allele 501: 10-217-91 : polymorphic base C or T
  misc_binding 482..500: 10-217-91.mis1
  misc_binding 502..521: 10-217-91.mis2, potential complement
  primer_bind 411..427: upstream amplification primer
  primer_bind 761..777: downstream amplification primer, complement
  misc_binding 489..513: 10-217-91 potential probe
  misc_feature 20,100,257,279,368,377,432,453,460,615,634,921,946,986: n=a, g, c or t
catgtaaaaggagactgggnatatacaggctggagaccacatcaggtggctgggcatgtgggataaatcctattgagcatctgtcatagggcctgtcacnttagtagacagtcactaaatatttgttaaatacatgatgcctgtttaacacattttctacaaccatggagacctccacaactgatgtaggacaaaatctttctgctttgaactctagcctttcgggccagtgggatttatgaaaaatgccatctctnatagctgaggatgaagaatggnaagagaatacgatcattgctgtctccaacattcaccagcggaaaactcaaggaggtatgaaaataacttgggttttaattagaaacttnaaagaatgnaatcaggtggggacaggtagaaagtaagatcagagttcctttccgaggagtagtnctgctgaatttgagcttcctnaaaaatnagtctttttatgtacagaaaacacatcataaaattcattayacaatgtcacttattgttccatgccaggcaaagtcatgtccttctgggacttatgtctgcacatttaactatgggtggtgttgtgttttgtgcttagatggtccctatcattgncccagtatggagatgtgtntggtgagaaatctgaggcgggaagcagagacaggcaagcctgtcaccttgaaacagtaagtaggagcacagccatggggttctgagctgtcatgagcccctccagctgcctgctatggagctgatactcccgctgttgggttattccagtgaccagacaaaaggagggctgtggtaatgcaacttcaatgggtctcccaagatggggcagctccgatgaggaggtggggcagctggaggaaaaggatcttctcccctgtgcacagaggtcagggtttacatatctgnttaaattgtcaccttggatattctnggaggactaaatacatcctttagggggaaaagtgtgattngtatcaaagttttaa

SEQ ID NO: 87 - DNA, 1001 bp, Homo Sapiens
  allele 503: 10-213-292 : polymorphic base G or C
  misc_binding 484..502: 10-213-292.mis1
  misc_binding 504..523: 10-213-292.mis2, potential complement
  primer_bind 212..230: upstream amplification primer
  primer_bind 590..608: downstream amplification primer, complement
  misc_binding 491..515: 10-213-292 potential probe
  misc_feature 86,281,718,743,788,878,885,890,1000: n=a, g, c or t
attagtcatgtttgcttccatgagaaagaaaaaccactacatggttatgctaaggatttcagtcattggggttagagccttcccgnaatgtctcctgctttcataactcctccacacatcttagtgggccattgagcacatcaaagggcatgacagttattaaaatactttatgaatgctacaatcctttgccagtatgagttgttctctggaacttctaacagttcaacagtactacatggactgagttaaaagttaattcaaaaatctcaatttatccnaaatctgtttctttcttttcaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggasagagcctgagaagttcctccctgaaaggtaggaggcccctgggaagggagccctccctgaaccagcctggttcaagcatattctgcctctctacaggacagtctgggcttgtacaatcatttgcttgtctttttatgtttaaaaggttttttcaaatcatgaaattgatcattgtcacactttacaaaccacagactagataaaagaaaactatnagccagtcacagtcccagcaacttnaagatgaaggtcctcaattatgtccttatgggtcataagtgtccnaaaatgtaaggactcttttaaaaacacatgatcacaatgctattattatgtcccacaaatgaatattttttcctgaatataatcaaatcnttcaggnaatcnaaatttgaataaaaaacatgcgtctaatcttcaaagaatttataggttagtgcaacagatagacaaagaaagcagtgatgacactgctttccatcaatacagtagcatcna

SEQ ID NO: 88 - DNA, 1001 bp, Homo Sapiens
  allele 501: 10-214-279 : polymorphic base C or T
  misc_binding 481..500: 10-214-279.mis1, potential
  misc_binding 502..521: 10-214-279.mis2, potential complement
  primer_bind 154..174: upstream amplification primer
  primer_bind 746..763: downstream amplification primer, complement
  misc_binding 489..513: 10-214-279 potential probe
ctcatccattttacttaaaatttaaatcaaaaaagaacacaggtttccatgaatttgtctcaggcctggcacagaatagtactccataaatattttgttaaatgatagatgatgaatgctctcactgtccaatcttcacacatcttatagactaagtataaagaatccaagatttatagtgctgaaagtagtttttatatgtttacaaagcattattgtcattactgcattttttttgcccattactccatagagatcagaatatcactctgttgtgtcccctcaacactgaaggagtgtctcactcactttgatgctatactttctacttttgtttatttaatgcttctcaatatgcttgtttaactgttgcagatccccctgaaattaagcttaggaggacttcttcaaccagaaaaacccgttgttctaaaggttgagtcaagggatggcaccgtaagtggagcctgaattttcctaaggacttctgctttgctcttyaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttg

SEQ ID NO: 89 - DNA, 1001 bp, Homo Sapiens
  allele 501: 10-214-380 : polymorphic base A or G
  misc_binding 481..500: 10-214-380.mis1, potential
  misc_binding 502..520: 10-214-380.mis2, complement
  primer_bind 124..143: upstream amplification primer
  primer_bind 647..664: downstream amplification primer, complement
  misc_binding 489..513: 10-214-380 potential probe
  misc_feature 398,723,730,789: n=a, g, c or t
gaacacgggttcccatgaatttgtctcaggtcaaacctcacacagaataggtgctccatgaatattttgttaaatgatagatgatgaatgttctcactatccaatcttcacacatcttatagagtaagtataacgaatccaagatttatagtgctgaaagtagtttttatatgtttacaaagcattattgtcagtaatttttttttactttgatgctatactttctacttttgctttatttaatgcttctcaatatgctcgtttaactgttgcagatccccctgaaattacgctttggaggacttcttctaacagaaaaacccattgttctaaaggctgagtcaagggatgagaccgtaagtggagcctgatttccctaaggacttctggtttgctcntttaagaaagctgtgccccagaacaccagagacctcaaattactttacaaatagaaccctgaaatgaagacgggcttcatccaatgtgctgcataaataatcrgggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaantaggaanttattttgatggctctaacagtgacatttatatcatgtgttatatctgtagtattctantagtaagctttatattaagcaaatcaataaaaacctctttacaaaagtattattggatgtttcctgcacattaaggagaaatctatagaactgaatgactgagaaccaacaactaaatattttgatcattgtaatcactgttggtgtgggaactggagtgcagtggtgcaatcttggctcactgcgagctctgcctcccaggttcacgccat

SEQ ID NO: 90 - DNA, 437 bp, Homo Sapiens
  allele 216: 2-1-216 : polymorphic base A or G
  misc_binding 196..215: 2-1-216.mis1, potential
  misc_binding 217..236: 2-1-216.mis2, potential complement
  primer_bind 1..18: upstream amplification primer
  primer_bind 417..437: downstream amplification primer, complement
  misc_binding 204..228: 2-1-216 potential probe
gcccaaagaagtgtgttgtgtttgcttatttcttacagagtaatgctgaaatctgtgttgcttttccccaccaggtcattatcagtaccagaagtgcttcctgggtcatgagtcgggtctgggatgatggctatccttgggatatgatgtatgttacccgctttgcatcctttctccggaatgtccttccttcattcatctctgactggttatatrtccagaagatgaacacgtggtttaagcatgagaactatggcctgatgcctttaaatgggtacttaaaaatggaaattttttttattcaaaaaaggggggcactcatttaatgaatttattctctctagaacttacttttgttgtctcattgagcctagaaacattaaactcaaggtttcataggtgacggaatatgcccagagaccacgtatggcttggaa

SEQ ID NO: 91 - DNA, 437 bp, Homo Sapiens
  allele 397: 2-1-397 : polymorphic base C or T
  misc_binding 377..396: 2-1-397.mis1, potential
  misc_binding 398..417: 2-1-397.mis2, potential complement
  primer_bind 1..18: upstream amplification primer
  primer_bind 417..437: downstream amplification primer, complement
  misc_binding 385..409: 2-1-397 potential probe
gcccaaagaagtgtgttgtgtttgcttatttcttacagagtaatgctgaaatctgtgttgcttttccccaccaggtcattatcagtaccagaagtgcttcctgggtcatgagtcgggtctgggatgatggctatccttgggatatgatgtatgttacccgctttgcatcctttctccggaatgtccttccttcattcatctctgactggttatatgtccagaagatgaacacgtggtttaagcatgagaactatggcctgatgcctttaaatgggtacttaaaaatggaaattttttttattcaaaaaaggggggcactcatttaatgaatttattctctctagaacttacttttgttgtctcattgagcctagaaacattaaactcaaggtttcayaggtgacggaatatgcccagagaccacgtatggcttggaa

SEQ ID NO: 92 - DNA, 426 bp, Homo Sapiens
  allele 232: 2-3-232 : polymorphic base C or T
  misc_binding 212..231: 2-3-232.mis1, potential
  misc_binding 233..252: 2-3-232.mis2, potential complement
  primer_bind 1..18: upstream amplification primer
  primer_bind 406..426: downstream amplification primer, complement
  misc_binding 220..244: 2-3-232 potential probe
  misc_feature 419: n=a, g, c or t
gagtvgcagacttttcagtgcctttccattcatgacacttcttgaatctctggcagaaccagccagccgtgttcacagtgtcaaatgaagggatgtctttgattgcttccaggtgttcctcagcaccaccggagggggatgggtgatcagccgaatctttgactcgggctacccatgggacatggtgttcatgacacgctttcagaacatgttgagaaattccctcccaacyccaattgtgacttggttgatggagcgaaagataaacaactggctcaatcatgcaaattacggcttaataccagaagacaggtaaatataatgtgactgccaagggcttttaggaagaaggagcctctgcctgtccagcagcctatacaagccaggcagtaccacagcaacatggctgaatgtgtggnaacactt

SEQ ID NO: 93 - DNA, 429 bp, Homo Sapiens
  allele 51: 2-4-51 : polymorphic base A or C
  misc_binding 31..50: 2-4-51.mis1, potential
  misc_binding 52..71: 2-4-51.mis2, potential complement
  primer_bind 3..24: upstream amplification primer
  primer_bind 405..429: downstream amplification primer, complement
  misc_binding 39..63: 2-4-51 potential probe
gygctgttactgtaaagacattgcattactactgttgacctcagagcacgmgcctcttgcctaattctaggactcctaactaagtctttggagtttcagctggaagaatgctggaggaatacggaactcctcccatttctcacagccacctccaactcttaaaaacgcttccaactgcctcccagcacacaaccaagggagaaaactattctgtcaaagagacggtgccaaaaggcaaaaacaaaggtaaggatgatcgctggggaaagaagctgaaaaggaaaagctcagaactctagctggaaatttggctcacatccctagtatgttactgcatagtctggctttgttcaatgggtcgcttttaaatattaaagctagatgtaagcaaggtttgcaacaaagtccataagaaactcagcttttctc

SEQ ID NO: 94 - DNA, 429 bp, Homo Sapiens
  allele 126: 2-4-126 : polymorphic base A or G
  misc_binding 106..125: 2-4-126.mis1, potential
  misc_binding 127..146: 2-4-126.mis2, potential complement
  primer_bind 3..24: upstream amplification primer
  primer_bind 405..429: downstream amplification primer, complement
  misc_binding 114..138: 2-4-126 potential probe
gygctgttactgtaaagacattgcattactactgttgacctcagagcacgagcctcttgcctaattctaggactcctaactaagtctttggagtttcagctggaagaatgctggaggaatacggarctcctcccatttctcacagccacctccaactcttaaaaacgcttccaactgcctcccagcacacaaccaagggagaaaactattctgtcaaagagacggtgccaaaaggcaaaaacaaaggtaaggatgatcgctggggaaagaagctgaaaaggaaaagctcagaactctagctggaaatttggctcacatccctagtatgttactgcatagtctggctttgttcaatgggtcgcttttaaatattaaagctagatgtaagcaaggtttgcaacaaagtccataagaaactcagcttttctc

SEQ ID NO: 95 - DNA, 420 bp, Homo Sapiens
  allele 202: 2-5-202 : polymorphic base A or G
  misc_binding 182..201: 2-5-202.mis1, potential
  misc_binding 203..222: 2-5-202.mis2, potential complement
  primer_bind 1..25: upstream amplification primer
  primer_bind 400..420: downstream amplification primer, complement
  misc_binding 190..214: 2-5-202 potential probe
tgtttaaagccaatthcctgagcacatcataaggattctcttaccggttgtcccagttaagtaatgttgattgatcaactccttgacaggagctgatggcaaagaaggtagctgtgattggagctggggtcagtggcctaatttctctgaagtgctgtgtggatgagggacttgagcccacttgctttgagagaactgaagrtattggaggagtgtggaggttcaaagtaagtgagattttcttgggtcttgaacaggttgtgttgttatttcagggtgaatcacagttactgatgggtcatattgagaaatttattaaacaactctgatcagattttatttctacttattgatgtggccataatggaactgaagtcataggctggcatctctcccccagtcaatactaacccaacccag

SEQ ID NO: 96 - DNA, 420 bp, Homo Sapiens
  allele 275: 2-5-275 : polymorphic base A or G
  misc_binding 255..274: 2-5-275.mis1, potential
  misc_binding 276..295: 2-5-275.mis2, potential complement
  primer_bind 1..25: upstream amplification primer
  primer_bind 400..420: downstream amplification primer, complement
  misc_binding 263..287: 2-5-275 potential probe
tgtttaaagccaatthcctgagcacatcataaggattctcttaccggttgtcccagttaagtaatgttgattgatcaactccttgacaggagctgatggcaaagaaggtagctgtgattggagctggggtcagtggcctaatttctctgaagtgctgtgtggatgagggacttgagcccacttgctttgagagaactgaagatattggaggagtgtggaggttcaaagtaagtgagattttcttgggtcttgaacaggttgtgttgttatttcarggtgaatcacagttactgatgggtcatattgagaaatttattaaacaactctgatcagattttatttctacttattgatgtggccataatggaactgaagtcataggctggcatctctcccccagtcaatactaacccaacccag

SEQ ID NO: 97 - DNA, 420 bp, Homo Sapiens
  allele 346: 2-5-346 : polymorphic base C or T
  misc_binding 326..345: 2-5-346.mis1, potential
  misc_binding 347..366: 2-5-346.mis2, potential complement
  primer_bind 1..25: upstream amplification primer
  primer_bind 400..420: downstream amplification primer, complement
  misc_binding 334..358: 2-5-346 potential probe
tgtttaaagccaatthcctgagcacatcataaggattctcttaccggttgtcccagttaagtaatgttgattgatcaactccttgacaggagctgatggcaaagaaggtagctgtgattggagctggggtcagtggcctaatttctctgaagtgctgtgtggatgagggacttgagcccacttgctttgagagaactgaagatattggaggagtgtggaggttcaaagtaagtgagattttcttgggtcttgaacaggttgtgttgttatttcagggtgaatcacagttactgatgggtcatattgagaaatttattaaacaactctgatcagattttatttctayttattgatgtggccataatggaactgaagtcataggctggcatctctcccccagtcaatactaacccaacccag

SEQ ID NO: 98 - DNA, 430 bp, Homo Sapiens
  allele 171: 2-8-171 : polymorphic base A or G
  misc_binding 151..170: 2-8-171.mis1, potential
  misc_binding 172..191: 2-8-171.mis2, potential complement
  primer_bind 1..18: upstream amplification primer
  primer_bind 405..427: downstream amplification primer, complement
  misc_binding 159..183: 2-8-171 potential probe
ggttcaagatycctcagcaaatgatccttcagaatgtttttcttctgtatgtctcagatacattatgaaggaacctgtactaaatgatgatgtcccaagtcgtctactctgtggagccatcaaggtgaaatctacagtgaaagagctcacagaaacttctgccatctttgrggatggaacagtggaggagaacattgatgtcatcatttttgcaacaggatatagtttctcttttcccttccttgaagattcactcgttaaagtagagaataatatggtctcactgtataaatacatattccccgctcacctggacaagtcaaccctcgcgtgcattggtctcatccagcccctaggttccattttcccaactgctgaacttcaagctcgttgggtgacaagagtttcaaaggtaagtgtgtaggcaggt

SEQ ID NO: 99 - DNA, 428 bp, Homo Sapiens
  allele 188: 2-9-188 : polymorphic base A or G
  misc_binding 168..187: 2-9-188.mis1, potential
  misc_binding 189..208: 2-9-188.mis2, potential complement
  primer_bind 1..21: upstream amplification primer
  primer_bind 396..420: downstream amplification primer, complement
  misc_binding 176..200: 2-9-188 potential probe
tcacatwgagtgctatgggggtggcaccccctgaagttcaacagcacggaagccctgactggtatgacatggttcaatgtccagagtttaattttaagaatcaacaactagacaaagtaatgatattgactcaaacttactattcaaaccaaccttttattccttaggcttgtgtagcctgccctcaragagaactatgatgatggacattatcaaaaggaatgaaaaaagaattgacctgtaagaattttttttaattctttacatgaagcagtgtttctcaaagtacagtgatctaactacttacaagaaccacctagctgcctgataaaatgcaaatttctgggctatagcccagatgattgaatcagaaactccgtgtgtgaggctaaaaagttgcatttttatcttcttcctaagggtcatag

SEQ ID NO: 100 - DNA, 428 bp, Homo Sapiens
  allele 223: 2-9-223 : polymorphic base G or T
  misc_binding 203..222: 2-9-223.mis1, potential
  misc_binding 224..243: 2-9-223.mis2, potential complement
  primer_bind 1..21: upstream amplification primer
  primer_bind 396..420: downstream amplification primer, complement
  misc_binding 211..235: 2-9-223 potential probe
tcacatwgagtgctatgggggtggcaccccctgaagttcaacagcacggaagccctgactggtatgacatggttcaatgtccagagtttaattttaagaatcaacaactagacaaagtaatgatattgactcaaacttactattcaaaccaaccttttattccttaggcttgtgtagcctgccctcagagagaactatgatgatggacattatcaaaaggaakgaaaaaagaattgacctgtaagaattttttttaattctttacatgaagcagtgtttctcaaagtacagtgatctaactacttacaagaaccacctagctgcctgataaaatgcaaatttctgggctatagcccagatgattgaatcagaaactccgtgtgtgaggctaaaaagttgcatttttatcttcttcctaagggtcatag

SEQ ID NO: 101 - DNA, 450 bp, Homo Sapiens
  allele 107: 2-10-107 : polymorphic base C or T
  misc_binding 87..106: 2-10-107.mis1, potential
  misc_binding 108..127: 2-10-107.mis2, potential complement
  primer_bind 1..18: upstream amplification primer
  primer_bind 423..443: downstream amplification primer, complement
  misc_binding 95..119: 2-10-107 potential probe
caaactgagcaaatcgcctaatcttccaaattctttttcctggcttgttagagcagccaagggtggggtggagcttgtgaataaaaagcctgcttcatcttcctcaygcaggagaacatggccaagcgagttgccattgtgggagctggggtcagcggcctggcctccatcaagtgctgtctggaagaaggactggagcccacctgctttgagaggagcgatgaccttggggggctgtggagattcaccgtaagtggggtttcaacaactttatctgtctatggagaatggcttggcagctgggaaattatatctgtgcttctttcacaagggttggtggccttgaggaaggttagaaatgtctgctgaacaggggaccatgaggagccactgaaattgtaaaagaaacaggacatgggtgagctagggtggaagtcagaacaggtcata

SEQ ID NO: 102 - DNA, 450 bp, Homo Sapiens
  allele 377: 2-10-378 : polymorphic base A or G
  misc_binding 357..376: 2-10-378.mis1, potential
  misc_binding 378..397: 2-10-378.mis2, potential complement
  primer_bind 1..18: upstream amplification primer
  primer_bind 423..443: downstream amplification primer, complement
  misc_binding 365..389: 2-10-378 potential probe
caaactgagcaaatcgcctaatcttccaaattctttttcctggcttgttagagcagccaagggtggggtggagcttgtgaataaaaagcctgcttcatcttcctcatgcaggagaacatggccaagcgagttgccattgtgggagctggggtcagcggcctggcctccatcaagtgctgtctggaagaaggactggagcccacctgctttgagaggagcgatgaccttggggggctgtggagattcaccgtaagtggggtttcaacaactttatctgtctatggagaatggcttggcagctgggaaattatatctgtgcttctttcacaagggttggtggccttgaggaaggttagaaatgtctgctgaacaggggrccatgaggagccactgaaattgtaaaagaaacaggacatgggtgagctagggtggaagtcagaacaggtcata

SEQ ID NO: 103 - DNA, 446 bp, Homo Sapiens
  allele 284: 2-11-284 : polymorphic base A or G
  misc_binding 264..283: 2-11-284.mis1, potential
  misc_binding 285..304: 2-11-284.mis2, potential complement
  primer_bind 1..18: upstream amplification primer
  primer_bind 429..446: downstream amplification primer, complement
  misc_binding 272..296: 2-11-284 potential probe
tcagctagtcagactcacatttattcggtaagattaattaacagaagcttgagtcaacaccgttagagggtaattgatattatggacttcccaagtaaaaagcacttaagcacctgccgtacatcaaaggttagttttaagatcacatgagtaaacaaactaggtaggtaaactactctgccttcctttgttactactttaatttgtttaactaaaggtaaagatcaggttgccttcaaccatatctattactgaagttatgcaaacttctcggccttccaagragatttgtgtctatctccataactatctttaatatttttcccaccagcctgattgaaccccagcatagatatttaataaaaatttggccattccgttgttggaagttttaagataaatttattattattattttaatgagaaaagcctcagtaaagctgact

SEQ ID NO: 104 - DNA, 446 bp, Homo Sapiens
  allele 156: 2-11-156 : polymorphic base A or C
  misc_binding 136..155: 2-11-156.mis1, potential
  misc_binding 157..176: 2-11-156.mis2, potential complement
  primer_bind 1..18: upstream amplification primer
  primer_bind 429..446: downstream amplification primer, complement
  misc_binding 144..168: 2-11-156 potential probe
tcagctagtcagactcacatttattcggtaagattaattaacagaagcttgagtcaacaccgttagagggtaattgatattatggacttcccaagtaaaaagcacttaagcacctgccgtacatcaaaggttagttttaagatcacatgagtaaamaaactaggtaggtaaactactctgccttcctttgttactactttaatttgtttaactaaaggtaaagatcaggttgccttcaaccatatctattactgaagttatgcaaacttctcggccttccaagaagatttgtgtctatctccataactatctttaatatttttcccaccagcctgattgaaccccagcatagatatttaataaaaatttggccattccgttgttggaagttttaagataaatttattattattattttaatgagaaaagcctcagtaaagctgact

SEQ ID NO: 105 - DNA, 446 bp, Homo Sapiens
  allele 379: 2-11-379 : polymorphic base A or G
  misc_binding 359..378: 2-11-379.mis1, potential
  misc_binding 380..399: 2-11-379.mis2, potential complement
  primer_bind 1..18: upstream amplification primer
  primer_bind 429..446: downstream amplification primer, complement
  misc_binding 367..391: 2-11-379 potential probe
tcagctagtcagactcacatttattcggtaagattaattaacagaagcttgagtcaacaccgttagagggtaattgatattatggacttcccaagtaaaaagcacttaagcacctgccgtacatcaaaggttagttttaagatcacatgagtaaacaaactaggtaggtaaactactctgccttcctttgttactactttaatttgtttaactaaaggtaaagatcaggttgccttcaaccatatctattactgaagttatgcaaacttctcggccttccaagaagatttgtgtctatctccataactatctttaatatttttcccaccagcctgattgaaccccagcatagatatttaataaaaatttggccattccrttgttggaagttttaagataaatttattattattattttaatgagaaaagcctcagtaaagctgact

SEQ ID NO: 106 - DNA, 423 bp, Homo Sapiens
  allele 223: 2-12-223 : polymorphic base A or T
  misc_binding 203..222: 2-12-223.mis1, potential
  misc_binding 224..243: 2-12-223.mis2, potential complement
  primer_bind 1..25: upstream amplification primer
  primer_bind 399..420: downstream amplification primer, complement
  misc_binding 211..235: 2-12-223 potential probe
ctgttgcaggtatttcttggaaatgagctatttacagcaagggtgtttgcctctcattgctgtagttccctgagaaaagagcctgtgttcaatgatgagctcccatcccgcatcctgtgtggcactctgtccatcaagcccagtgtgaaggagttcacggaaacctcagctgtgtttgaggatgggaccatgtttgaggctatcgactctgtcatctttgcawcaggctatgattattcctaccccttccttgatgagaccatcatgaaaagcagaaacaatgaggttaccttgtttaaaggcatcttccccccactaatggagaagccaaccttggctgtgattggcttggttcagtcccttggagctgccatccccacagcagacctgcaagcctggtgggctgctaaagtatttgcaggt

SEQ ID NO: 107 - DNA, 418 bp, Homo Sapiens
  allele 239: 2-14-239 : polymorphic base C or T
  misc_binding 219..238: 2-14-239.mis1, potential
  misc_binding 240..259: 2-14-239.mis2, potential complement
  primer_bind 1..23: upstream amplification primer
  primer_bind 398..418: downstream amplification primer, complement
  misc_binding 227..251: 2-14-239 potential probe
gttcactgaarggvacacaattcttggctttctctttaagctttcttattctccctaggaccacacagaagaaggcagagccagcatttaccagtctgtattcacaaactcttccaaagaaatgatgtgctttccagacttcccttatccggatgattacccaaactatatacaccacagcaagctccaggaatatataaagacatatgctcaaaagaaggatcttttaagatacatayagtttgaggtaggggtctcataacttgtactgttgaaattaagatatgtgtgggttagagaaaaaggaggcagcaaactattataaaaattagagccaaatgtttgggcacctcagtaatcaaatgttggctctgattataaagcattcatgcattgattttttctcctagacttacta

SEQ ID NO: 108 - DNA, 418 bp, Homo Sapiens
  allele 370: 2-14-370 : polymorphic base G or C
  misc_binding 350..369: 2-14-370.mis1, potential
  misc_binding 371..390: 2-14-370.mis2, potential complement
  primer_bind 1..23: upstream amplification primer
  primer_bind 398..418: downstream amplification primer, complement
  misc_binding 358..382: 2-14-370 potential probe
gttcactgaarggvacacaattcttggctttctctttaagctttcttattctccctaggaccacacagaagaaggcagagccagcatttaccagtctgtattcacaaactcttccaaagaaatgatgtgctttccagacttcccttatccggatgattacccaaactatatacaccacagcaagctccaggaatatataaagacatatgctcaaaagaaggatcttttaagatacatayagtttgaggtaggggtctcataacttgtactgttgaaattaagatatgtgtgggttagagaaaaaggaggcagcaaactattataaaaattagagccaaatgtttgggcacctcagtaatcaaatgttggstctgattataaagcattcatgcattgattttttctcctagacttacta

SEQ ID NO: 109 - DNA, 445 bp, Homo Sapiens
  allele 104: 2-17-104 : polymorphic base A or G
  misc_binding 84..103: 2-17-104.mis1, potential
  misc_binding 105..124: 2-17-104.mis2, potential complement
  primer_bind 1..18: upstream amplification primer
  primer_bind 427..445: downstream amplification primer, complement
  misc_binding 92..116: 2-17-104 potential probe
cgttgatggaaaattcccctctgctctctgaagatttgctaaaaatctactgacaaaaggcatattgatagaagaaaatgtacacaaatttattaacttccacrggagttggggtaaaaatcacatgattatcccagcatgcaatggggtacggatgcttatatatcccttccttaggtgacagggagatgagaaagtgtggattgattttagggtgactatgaaatgatctctaggggacccaacgggcttgaagaacatacaatggcctggaataaagtatgttgggcccgcagcgcaaacaatggcttatgacaagtctgtctaggtgtgttgacagaattctttcttcctgcagtatgagttcagttaatgaaaactcagggaaggtaccaaaggtaattgatttcttctttggcaagtctagactttaggcaaataaggg

SEQ ID NO: 110 - DNA, 445 bp, Homo Sapiens
  allele 395: 2-17-396 : polymorphic base A or C
  misc_binding 375..394: 2-17-396.mis1, potential
  misc_binding 396..415: 2-17-396.mis2, potential complement
  primer_bind 1..18: upstream amplification primer
  primer_bind 427..445: downstream amplification primer, complement
  misc_binding 383..407: 2-17-396 potential probe
cgttgatggaaaattcccctctgctctctgaagatttgctaaaaatctactgacaaaaggcatattgatagaagaaaatgtacacaaatttattaacttccacaggagttggggtaaaaatcacatgattatcccagcatgcaatggggtacggatgcttatatatcccttccttaggtgacagggagatgagaaagtgtggattgattttagggtgactatgaaatgatctctaggggacccaacgggcttgaagaacatacaatggcctggaataaagtatgttgggcccgcagcgcaaacaatggcttatgacaagtctgtctaggtgtgttgacagaattctttcttcctgcagtatgagttcagttaatgaaaactcagggaaggtaccmaaggtaattgatttcttctttggcaagtctagactttaggcaaataaggg

SEQ ID NO: 111 - DNA, 436 bp, Homo Sapiens
  allele 43: 2-22-43 : polymorphic base A or G
  misc_binding 23..42: 2-22-43.mis1, potential
  misc_binding 44..63: 2-22-43.mis2, potential complement
  primer_bind 1..18: upstream amplification primer
  primer_bind 416..436: downstream amplification primer, complement
  misc_binding 31..55: 2-22-43 potential probe
aaggagttcacggaaacctcagctgtgtttgaggatgggaccrtgtttgaggctatcgactctgtcatctttgcaacaggctatgattattcctaccccttccttgatgagaccatcatgaaaagcagaaacaatgaggttaccttgtttaaaggcatcttccccccactaatggagaagccaaccttggctgtgattggcttggttcagtcccttggagctgccatccccacagcagacctgcaagcctggtgggctgctaaagtatttgcaagtaggtgggccattctgtctttcattcattttatcaatgaacatttactgaacacctgctatatgcaaagcactgtgctagggatacaatgagaacaagacaaacatgttccttgacctctcaaggcttaaaatggggtgtgggggatgcataataggggaa

SEQ ID NO: 112 - DNA, 436 bp, Homo Sapiens
  allele 138: 2-22-138 : polymorphic base A or G
  misc_binding 118..137: 2-22-138.mis1, potential
  misc_binding 139..158: 2-22-138.mis2, potential complement
  primer_bind 1..18: upstream amplification primer
  primer_bind 416..436: downstream amplification primer, complement
  misc_binding 126..150: 2-22-138 potential probe
aaggagttcacggaaacctcagctgtgtttgaggatgggaccatgtttgaggctatcgactctgtcatctttgcaacaggctatgattattcctaccccttccttgatgagaccatcatgaaaagcagaaacaatgargttaccttgtttaaaggcatcttccccccactaatggagaagccaaccttggctgtgattggcttggttcagtcccttggagctgccatccccacagcagacctgcaagcctggtgggctgctaaagtatttgcaagtaggtgggccattctgtctttcattcattttatcaatgaacatttactgaacacctgctatatgcaaagcactgtgctagggatacaatgagaacaagacaaacatgttccttgacctctcaaggcttaaaatggggtgtgggggatgcataataggggaa

SEQ ID NO: 113 - DNA, 420 bp, Homo Sapiens
  allele 82: 2-23-82 : polymorphic base A or G
  misc_binding 62..81: 2-23-82.mis1, potential
  misc_binding 83..102: 2-23-82.mis2, potential complement
  primer_bind 1..25: upstream amplification primer
  primer_bind 396..420: downstream amplification primer, complement
  misc_binding 70..94: 2-23-82 potential probe
caattatttcctccacagaaacaaggcaagaaggaaaaaaactttcacatgtagaattataaatggaaaaataaattttctrgttttcttaaagaccctggtttccggtataaagaaatgtcccagcttcttagtcacgggccaatgggttgttgttactgaaaaggatgggaaacaggaatctactatttttgatgctgtaatgatttgttcaggacatcacgtataccccaatctgccaacggattcctttcctggtaagtttggaaaatatataataatctagggacttatatgcaaacatcaagagttagaaacatatctttctataggtattacataatgattattcttagatttcaaaagaaaaaaattaagtttaatgataggatatagtaataaatagccycataagtcctt

SEQ ID NO: 114 - DNA, 420 bp, Homo Sapiens
  allele 166: 2-23-166 : polymorphic base A or G
  misc_binding 146..165: 2-23-166.mis1, potential
  misc_binding 167..186: 2-23-166.mis2, potential complement
  primer_bind 1..25: upstream amplification primer
  primer_bind 396..420: downstream amplification primer, complement
  misc_binding 154..178: 2-23-166 potential probe
caattatttcctccacagaaacaaggcaagaaggaaaaaaactttcacatgtagaattataaatggaaaaataaattttctagttttcttaaagaccctggtttccggtataaagaaatgtcccagcttcttagtcacgggccaatgggttgttgttactgaaaargatgggaaacaggaatctactatttttgatgctgtaatgatttgttcaggacatcacgtataccccaatctgccaacggattcctttcctggtaagtttggaaaatatataataatctagggacttatatgcaaacatcaagagttagaaacatatctttctataggtattacataatgattattcttagatttcaaaagaaaaaaattaagtttaatgataggatatagtaataaatagccycataagtcctt

SEQ ID NO: 115 - DNA, 420 bp, Homo Sapiens
  allele 244: 2-23-244 : polymorphic base G or T
  misc_binding 224..243: 2-23-244.mis1, potential
  misc_binding 245..264: 2-23-244.mis2, potential complement
  primer_bind 1..25: upstream amplification primer
  primer_bind 396..420: downstream amplification primer, complement
  misc_binding 232..256: 2-23-244 potential probe
caattatttcctccacagaaacaaggcaagaaggaaaaaaactttcacatgtagaattataaatggaaaaataaattttctagttttcttaaagaccctggtttccggtataaagaaatgtcccagcttcttagtcacgggccaatgggttgttgttactgaaaaggatgggaaacaggaatctactatttttgatgctgtaatgatttgttcaggacatcacgtataccccaatctgccaackgattcctttcctggtaagtttggaaaatatataataatctagggacttatatgcaaacatcaagagttagaaacatatctttctataggtattacataatgattattcttagatttcaaaagaaaaaaattaagtttaatgataggatatagtaataaatagccycataagtcctt

SEQ ID NO: 116 - DNA, 434 bp, Homo Sapiens
  allele 115: 2-24-115 : polymorphic base C or T
  misc_binding 95..114: 2-24-115.mis1, potential
  misc_binding 116..135: 2-24-115.mis2, potential complement
  primer_bind 1..18: upstream amplification primer
  primer_bind 416..434: downstream amplification primer, complement
  misc_binding 103..127: 2-24-115 potential probe
aatgcacttcaactagggaattttttaattacaactgataataggtttaaaaagacacaaagaaaacatcttcataatttctgaaaatcagttcaaacaacttgccatgttccayttaggcctggaccagtttcgaggcaactacctccatagccgggattataagaatccagaagccttcaaggggaagagggtcctcgtgattggtctggggaattcgggatctgacattgctgttgagctcagccgtctggctacacaggtacatgacgtaaaggttttgggaaataaacctaaggtagggctgtgctactaaatcagtagccaaggcacagaggatggtacttctatgtcacaccacaagagatccacctcttctatgtggcccttcaaatcaaggaggacttgagacatcctccatgtgaagccaggta

SEQ ID NO: 117 - DNA, 420 bp, Homo Sapiens
  allele 36: 2-25-36 : polymorphic base G or C
  misc_binding 16..35: 2-25-36.mis1, potential
  misc_binding 37..56: 2-25-36.mis2, potential complement
  primer_bind 1..21: upstream amplification primer
  primer_bind 396..420: downstream amplification primer, complement
  misc_binding 24..48: 2-25-36 potential probe
aggaaaatgcacggaagtgcccaaagaagtgtgttstgtttgcttatttcttacagagtaatgctgaaatctgtgttgcttttccccaccaggtcattatcagtaccagaagtgcttcctgggtcatgagtcgggtctgggatgatggctatccttgggatatgatgtatgttacccgctttgcatcctttctccggaatgtccttccttcattcatctctgactggttatatgtccagaagatgaacacgtggtttaagcatgagaactatggcctgatgcctttaaatgggtacttaaaaatggaaattttttttattcaaaaaaggggggcactcatttaatgaatttattctctctagaacttacttttgttgtctcattgagcctagaaacattaaactcaaggtttcacaggtg

SEQ ID NO: 118 - DNA, 429 bp, Homo Sapiens
  allele 185: 2-27-185 : polymorphic base A or G
  misc_binding 165..184: 2-27-185.mis1, potential
  misc_binding 186..205: 2-27-185.mis2, potential complement
  primer_bind 1..19: upstream amplification primer
  primer_bind 405..429: downstream amplification primer, complement
  misc_binding 173..197: 2-27-185 potential probe
cttattccagtatgttctcttctttcttcatgtttggccagagccagactttgcagacagattacatcacatatgtggatgagctgggctctttcataggggccaagcctaacataccatggctcttcctgacagatccccgcctggccctggaggtgtactttggcccttgcagcccataccartttcgactgatgggaccagggaagtgggatggggccagaaatgccatcctgacccagtggaaccggacagtgaagccaaccaggacaagagttgtcagtgaagttcagcgaccccatcccttttacaatttgcttaaaatgctttcattcccattactccttctggctgttacacttacattttattaatgagaaagtctttgaggtctcaaaattcagcatagaagtgtaatcacacaataca

SEQ ID NO: 119 - DNA, 429 bp, Homo Sapiens
  allele 378: 2-27-378 : polymorphic base G or C
  misc_binding 358..377: 2-27-378.mis1, potential
  misc_binding 379..398: 2-27-378.mis2, potential complement
  primer_bind 1..19: upstream amplification primer
  primer_bind 405..429: downstream amplification primer, complement
  misc_binding 366..390: 2-27-378 potential probe
cttattccagtatgttctcttctttcttcatgtttggccagagccagactttgcagacagattacatcacatatgtggatgagctgggctctttcataggggccaagcctaacataccatggctcttcctgacagatccccgcctggccctggaggtgtactttggcccttgcagcccataccagtttcgactgatgggaccagggaagtgggatggggccagaaatgccatcctgacccagtggaaccggacagtgaagccaaccaggacaagagttgtcagtgaagttcagcgaccccatcccttttacaatttgcttaaaatgctttcattcccattactccttctggctgttacacttacattttattaatgasaaagtctttgaggtctcaaaattcagcatagaagtgtaatcacacaataca

SEQ ID NO: 120 - DNA, 440 bp, Homo Sapiens
  allele 142: 2-29-142 : polymorphic base A or G
  misc_binding 122..141: 2-29-142.mis1, potential
  misc_binding 143..162: 2-29-142.mis2, potential complement
  primer_bind 1..21: upstream amplification primer
  primer_bind 422..439: downstream amplification primer, complement
  misc_binding 130..154: 2-29-142 potential probe
  misc_feature 9,433: n=a, g, c or t
caattawtnactccagaaaggaaaagctggcaatgcagttttattgaaattagcttgacatagttgctctggagctcacagacttctctcttcttccccctgaaggtatggagaggttcaaaggccaatatttccatagccrccaatacaagcatccagatggatttggggaaaacgcatcctggtgattggaatgggaaacttgggctcagatattgctgttgagctgagtaagaatgctgctcaggtgtgatgctctctgcttaccatgtacctggaggggaggaagtggggatgccatactggagaaccycagccatataatcgcggctccaatcctcattaactagttggttggtagcgcattgtggcatcatagaaaatctggaagtcaagaaaccactttacctcctagctctgtcactaaccagcnatgaatg

SEQ ID NO: 121 - DNA, 440 bp, Homo Sapiens
  allele 166: 2-29-166 : polymorphic base C or T
  misc_binding 146..165: 2-29-166.mis1, potential
  misc_binding 167..186: 2-29-166.mis2, potential complement
  primer_bind 1..21: upstream amplification primer
  primer_bind 422..439: downstream amplification primer, complement
  misc_binding 154..178: 2-29-166 potential probe
  misc_feature 9,433: n=a, g, c or t
caattawtnactccagaaaggaaaagctggcaatgcagttttattgaaattagcttgacatagttgctctggagctcacagacttctctcttcttccccctgaaggtatggagaggttcaaaggccaatatttccatagccgccaatacaagcatccagatggatytggggaaaacgcatcctggtgattggaatgggaaacttgggctcagatattgctgttgagctgagtaagaatgctgctcaggtgtgatgctctctgcttaccatgtacctggaggggaggaagtggggatgccatactggagaaccycagccatataatcgcggctccaatcctcattaactagttggttggtagcgcattgtggcatcatagaaaatctggaagtcaagaaaccactttacctcctagctctgtcactaaccagcnatgaatg

SEQ ID NO: 122 - DNA, 440 bp, Homo Sapiens
  allele 204: 2-29-205 : polymorphic base C or T
  misc_binding 184..203: 2-29-205.mis1, potential
  misc_binding 205..224: 2-29-205.mis2, potential complement
  primer_bind 1..21: upstream amplification primer
  primer_bind 422..439: downstream amplification primer, complement
  misc_binding 192..216: 2-29-205 potential probe
  misc_feature 9,433: n=a, g, c or t
caattawtnactccagaaaggaaaagctggcaatgcagttttattgaaattagcttgacatagttgctctggagctcacagacttctctcttcttccccctgaaggtatggagaggttcaaaggccaatatttccatagccgccaatacaagcatccagatggatttggggaaaacgcatcctggtgattggaatgggaaactygggctcagatattgctgttgagctgagtaagaatgctgctcaggtgtgatgctctctgcttaccatgtacctggaggggaggaagtggggatgccatactggagaaccycagccatataatcgcggctccaatcctcattaactagttggttggtagcgcattgtggcatcatagaaaatctggaagtcaagaaaccactttacctcctagctctgtcactaaccagcnatgaatg

SEQ ID NO: 123 - DNA, 440 bp, Homo Sapiens
  allele 205: 2-29-206 : polymorphic base A or G
  misc_binding 185..204: 2-29-206.mis1, potential
  misc_binding 206..225: 2-29-206.mis2, potential complement
  primer_bind 1..21: upstream amplification primer
  primer_bind 422..439: downstream amplification primer, complement
  misc_binding 193..217: 2-29-206 potential probe
  misc_feature 9,433: n=a, g, c or t
caattawtnactccagaaaggaaaagctggcaatgcagttttattgaaattagcttgacatagttgctctggagctcacagacttctctcttcttccccctgaaggtatggagaggttcaaaggccaatatttccatagccgccaatacaagcatccagatggatttggggaaaacgcatcctggtgattggaatgggaaacttrggctcagatattgctgttgagctgagtaagaatgctgctcaggtgtgatgctctctgcttaccatgtacctggaggggaggaagtggggatgccatactggagaaccycagccatataatcgcggctccaatcctcattaactagttggttggtagcgcattgtggcatcatagaaaatctggaagtcaagaaaccactttacctcctagctctgtcactaaccagcnatgaatg

SEQ ID NO: 124 - DNA, 440 bp, Homo Sapiens
  allele 313: 2-29-314 : polymorphic base C or T
  misc_binding 293..312: 2-29-314.mis1, potential
  misc_binding 314..333: 2-29-314.mis2, potential complement
  primer_bind 1..21: upstream amplification primer
  primer_bind 422..439: downstream amplification primer, complement
  misc_binding 301..325: 2-29-314 potential probe
  misc_feature 9,433: n=a, g, c or t
caattawtnactccagaaaggaaaagctggcaatgcagttttattgaaattagcttgacatagttgctctggagctcacagacttctctcttcttccccctgaaggtatggagaggttcaaaggccaatatttccatagccgccaatacaagcatccagatggatttggggaaaacgcatcctggtgattggaatgggaaacttgggctcagatattgctgttgagctgagtaagaatgctgctcaggtgtgatgctctctgcttaccatgtacctggaggggaggaagtggggatgccatactggagaaccycagccatataatcgcggctccaatcctcattaactagttggttggtagcgcattgtggcatcatagaaaatctggaagtcaagaaaccactttacctcctagctctgtcactaaccagcnatgaatg

SEQ ID NO: 125 - DNA, 432 bp, Homo Sapiens
  allele 68: 2-32-68 : polymorphic base A or G
  misc_binding 48..67: 2-32-68.mis1, potential
  misc_binding 69..88: 2-32-68.mis2, potential complement
  primer_bind 1..21: upstream amplification primer
  primer_bind 413..432: downstream amplification primer, complement
  misc_binding 56..80: 2-32-68 potential probe
cctatgagtatcgcctggttgggcctgggcaatgggaaggagccagaaatgccatcttcacccagaarcaaagaatactgaagccactcaagactcgggccctgaaggattcatctaatttctcagtttcttttctgttgaaaatcctgggccttcttgctgttgttgtggcctttttttgccaacttcaatggtcctagtcagcataatgctttgggctttattatcttgtcagtcactacctcctaaagaaaaaaaaaaaggctagaagaaaaaacattacattcatgttctaattatagattttagagttaggtagtacagghaagggggaaattgtaaagaattagcagaattaggcatatgtacaaaaccaaaattttgtcatgaaattttgcctttccacgcttccctcagttcaccaaagttacc

SEQ ID NO: 126 - DNA, 424 bp, Homo Sapiens
  allele 357: 2-35-357 : polymorphic base C or T
  misc_binding 337..356: 2-35-357.mis1, potential
  misc_binding 358..377: 2-35-357.mis2, potential complement
  primer_bind 1..18: upstream amplification primer
  primer_bind 404..423: downstream amplification primer, complement
  misc_binding 345..369: 2-35-357 potential probe
gaagagcctattgacatcattgtctttgccactggatacacatttgctttccccttccttgatgagtctgtagtgaaagttgaagatggccaggcctcactgtacaagtatatcttccctgcacatctgcaaaagccaaccctggccattattggcctcatcaaacccttgggctccatgatacctacaggagaaacacaagctcggtgggctgttcgagtcctgaaaggtaagtataagaaatagcagggcatgtgtttttggtgtgccatgtgattctggatactggaaatgttgagactattattcctcctgcttctatttaaaataacagaatctttaaaagcaggatgcatyctattgtttgctgaattatactgtcataatgatttgttccattactgcataaatggtatatcagggg

SEQ ID NO: 127 - DNA, 435 bp, Homo Sapiens
  allele 256: 2-36-256 : polymorphic base G or C
  misc_binding 236..255: 2-36-256.mis1, potential
  misc_binding 257..276: 2-36-256.mis2, potential complement
  primer_bind 1..21: upstream amplification primer
  primer_bind 411..435: downstream amplification primer, complement
  misc_binding 244..268: 2-36-256 potential probe
atatcaatggtacatcaactggcaagtgcttaatggaacattgacaactgctaatcatatctgtgattcttttttcagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtacagcattttctstaactaactttaagttttctcgtgggagccattctgatgcttgattggtctgggaatgaattcctatggctgttccattaaatagttaaagttgggaggtaggaggaggctttttttgttttgttttgtttttttctagccagcattttctggccagtttttggctttcatttgttcca

SEQ ID NO: 128 - DNA, 435 bp, Homo Sapiens
  allele 353: 2-36-354 : polymorphic base A or C
  misc_binding 333..352: 2-36-354.mis1, potential
  misc_binding 354..373: 2-36-354.mis2, potential complement
  primer_bind 1..21: upstream amplification primer
  primer_bind 411..435: downstream amplification primer, complement
  misc_binding 341..365: 2-36-354 potential probe
atatcaatggtacatcaactggcaagtgcttaatggaacattgacaactgctaatcatatctgtgattcttttttcagaccaaagtctgcagtgtaacaaaatgctcagattctgctgtctctggccaatgggaggtggtcactatgcatgaagagaagcaagagtcagccatctttgatgctgtcatggtctgcactggctttcttactaatccttatttgccactggattcctttccaggtacagcattttctgtaactaactttaagttttctcgtgggagccattctgatgcttgattggtctgggaatgaattcctatggctgttccattaaatagttaaagttgggmggtaggaggaggctttttttgttttgttttgtttttttctagccagcattttctggccagtttttggctttcatttgttcca

SEQ ID NO: 129 - DNA, 449 bp, Homo Sapiens
  allele 236: 2-42-236 : polymorphic base C or T
  misc_binding 216..235: 2-42-236.mis1, potential
  misc_binding 237..256: 2-42-236.mis2, potential complement
  primer_bind 1..18: upstream amplification primer
  primer_bind 428..449: downstream amplification primer, complement
  misc_binding 224..248: 2-42-236 potential probe
agtgggtttgcgtgtttggaggcagattttttcccccactcacactttgggcactsacagtttttcagctgtctcatggagtttgcagcggcaagccacttctttcaaaggtcctgtgaattcttttggttttcctggtatgttcatgcagtacttcttggaggaaaatttcactgtgtgagtctccacatgctgttctgtctgtctgcgtggaaactgcaagttagtcctgcctyctatccaccattttccaacaatctgtcgttaaccatttcaaagtatagaattcagtggcatttagtacattcataatgctgtgtaaccacaacctctatccagtttcaaaacactttcatcacacccaaaagaaaactccatactcattagcaatccttccccattcccttctttccccagcccctggcagccactcgatcatgcctatttta

SEQ ID NO: 130 - DNA, 429 bp, Homo Sapiens
  allele 139: 2-43-139 : polymorphic base A or G
  misc_binding 119..138: 2-43-139.mis1, potential
  misc_binding 140..159: 2-43-139.mis2, potential complement
  primer_bind 1..18: upstream amplification primer
  primer_bind 395..419: downstream amplification primer, complement
  misc_binding 127..151: 2-43-139 potential probe
cattakcaatccttccccattcccttctttccccagcccctggcagccactcgatcatgcctattttaaattgaggaaactaaagctgagaaaagttatacaatttttccaacatgactctgataatagctggtgaacrcaatactcgaacccaggacttgtgattcccaagatcagactcctcccatatacctgtcttttatttcccaagtgcttgggcaatcagctgcacttaaaaagcctttacaaattgagtttactaatgtgagtaatatatgattttttaaaaataataattgtccctaaaggtgaaatggatcaaagcccttaaaagtgaatctgtggtgtagtaactgttaacataattgtcttattttattctcatccccttaaagaataaaattgatgaacaagtgaggggtcatagct

SEQ ID NO: 131 - DNA, 425 bp, Homo Sapiens
  allele 213: 2-44-215 : polymorphic base C or T
  misc_binding 193..212: 2-44-215.mis1, potential
  misc_binding 214..233: 2-44-215.mis2, potential complement
  primer_bind 3..23: upstream amplification primer
  primer_bind 398..420: downstream amplification primer, complement
  misc_binding 201..225: 2-44-215 potential probe
rhcctgcttttatttcccaagtgcttgggcaatcagctgcacttaaaaagcctttacaaattgagtttactaatgtgagtaatatatgattttttaaaaataataattgtccctaaaggtgaaatggatcaaagcccttaaaagtgaatctgtggtgtagtaactgttaacataattgtcttattttattctcatccccttaaagaataaaaytgatgaacaagtgaggatgctggtgtaactccctaacttagtttatagtctgtaagcagaagagtgagtctaaagtacatatcaccagacagtgtttctcctagcatttcgctgttgcattaatcaacaagttaaaatataaacaacggctaaccttgggtttcaaatttaacattccttatctcttagaccaggtttatccactgtggtca

SEQ ID NO: 132 - DNA, 442 bp, Homo Sapiens
  allele 38: 2-45-38 : polymorphic base C or T
  misc_binding 18..37: 2-45-38.mis1, potential
  misc_binding 39..58: 2-45-38.mis2, potential complement
  primer_bind 1..21: upstream amplification primer
  primer_bind 418..442: downstream amplification primer, complement
  misc_binding 26..50: 2-45-38 potential probe
gatgtaggaagagtaaaaaacaaaaaatttttgaatgygtaattatcactaattattttatttgatccttcaggagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccaggtattgtatttttggggaaatgggtttctctgcattagttcagctcatatttagatagaaaagttactctgataatgaaagcaattatgaatgaagtatcccattctaagtatttgttgaaatataacagcctcatataaaacccaaaaagtagtgtcattacccttggtattatagatt

SEQ ID NO: 133 - DNA, 442 bp, Homo Sapiens
  allele 183: 2-45-183 : polymorphic base C or T
  misc_binding 163..182: 2-45-183.mis1, potential
  misc_binding 184..203: 2-45-183.mis2, potential complement
  primer_bind 1..21: upstream amplification primer
  primer_bind 418..442: downstream amplification primer, complement
  misc_binding 171..195: 2-45-183 potential probe
gatgtaggaagagtaaaaaacaaaaaatttttgaatgcgtaattatcactaattattttatttgatccttcaggagaatgtggaagatggccgagcaagtatctatcaatctgtcgttaccaacaccagcaaagaaatgtcctgtttcagtgactttccaatgcctgaagattttccaaactycctgcataattctaaacttctggaatatttcaggatttttgctaaaaaatttgatctgctaaaatatattcagttccaggtattgtatttttggggaaatgggtttctctgcattagttcagctcatatttagatagaaaagttactctgataatgaaagcaattatgaatgaagtatcccattctaagtatttgttgaaatataacagcctcatataaaacccaaaaagtagtgtcattacccttggtattatagatt

SEQ ID NO: 134 - DNA, 442 bp, Homo Sapiens
  allele 335: 2-45-335 : polymorphic base A or T
  misc_binding 315..334: 2-45-335.mis1, potential
  misc_binding 336..355: 2-45-335.mis2, potential complement
  primer_bind 1..21: upstream amplification primer
  primer_bind 418..442: downstream amplification primer, complement
  misc_binding 323..347: 2-45-335 potential probe
gatgtaggaagagtaaaaaacaaaaaatttttgaatgcgtaattatcactaattattttatttgatccttcaggagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccaggtattgtatttttggggaaatgggtttctctgcattagttcagctcatatttagatagaaaagttactctgawaatgaaagcaattatgaatgaagtatcccattctaagtatttgttgaaatataacagcctcatataaaacccaaaaagtagtgtcattacccttggtattatagatt

SEQ ID NO: 135 - DNA, 442 bp, Homo Sapiens
  allele 394: 2-45-394 : polymorphic base C or T
  misc_binding 374..393: 2-45-394.mis1, potential
  misc_binding 395..414: 2-45-394.mis2, potential complement
  primer_bind 1..21: upstream amplification primer
  primer_bind 418..442: downstream amplification primer, complement
  misc_binding 382..406: 2-45-394 potential probe
gatgtaggaagagtaaaaaacaaaaaatttttgaatgcgtaattatcactaattattttatttgatccttcaggagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccaggtattgtatttttggggaaatgggtttctctgcattagttcagctcatatttagatagaaaagttactctgataatgaaagcaattatgaatgaagtatcccattctaagtatttgttgaaatataacagcytcatataaaacccaaaaagtagtgtcattacccttggtattatagatt

SEQ ID NO: 136 - DNA, 426 bp, Homo Sapiens
  allele 39: 2-48-39 : polymorphic base A or G
  misc_binding 19..38: 2-48-39.mis1, potential
  misc_binding 40..59: 2-48-39.mis2, potential complement
  primer_bind 1..24: upstream amplification primer
  primer_bind 404..426: downstream amplification primer, complement
  misc_binding 27..51: 2-48-39 potential probe
gttttattttattgatgggctgtctggctccctcaactrcaaagtaaactccacaaaggcagagagttttgcctcttttattcattgctgtacctgcatcacttagaaagtttctggcacctaggaagtgttcagtaaatatttattgaataagtttatgtaaaacgtctcagactccttagagaaactggtcttttggggttggagaataaagttctttacctcatcagttagactctatctaaggtacacgagggcttgctagtctcctaagttagtctgctaataaatgttaaccctaataactgaaattattagcagaggtaattatccagttctatatcaaggcaaaaagacagcagtggatagaaagatcttagaagtcccactaggttcatccaagccaccatacacataggcagaaaa

SEQ ID NO: 137 - DNA, 426 bp, Homo Sapiens
  allele 72: 2-48-72 : polymorphic base C or T
  misc_binding 52..71: 2-48-72.mis1, potential
  misc_binding 73..92: 2-48-72.mis2, potential complement
  primer_bind 1..24: upstream amplification primer
  primer_bind 404..426: downstream amplification primer, complement
  misc_binding 60..84: 2-48-72 potential probe
gttttattttattgatgggctgtctggctccctcaactacaaagtaaactccacaaaggcagagagttttgyctcttttattcattgctgtacctgcatcacttagaaagtttctggcacctaggaagtgttcagtaaatatttattgaataagtttatgtaaaacgtctcagactccttagagaaactggtcttttggggttggagaataaagttctttacctcatcagttagactctatctaaggtacacgagggcttgctagtctcctaagttagtctgctaataaatgttaaccctaataactgaaattattagcagaggtaattatccagttctatatcaaggcaaaaagacagcagtggatagaaagatcttagaagtcccactaggttcatccaagccaccatacacataggcagaaaa

SEQ ID NO: 138 - DNA, 426 bp, Homo Sapiens
  allele 156: 2-48-156 : polymorphic base G or T
  misc_binding 136..155: 2-48-156.mis1, potential
  misc_binding 157..176: 2-48-156.mis2, potential complement
  primer_bind 1..24: upstream amplification primer
  primer_bind 404..426: downstream amplification primer, complement
  misc_binding 144..168: 2-48-156 potential probe
gttttattttattgatgggctgtctggctccctcaactacaaagtaaactccacaaaggcagagagttttgcctcttttattcattgctgtacctgcatcacttagaaagtttctggcacctaggaagtgttcagtaaatatttattgaataagtktatgtaaaacgtctcagactccttagagaaactggtcttttggggttggagaataaagttctttacctcatcagttagactctatctaaggtacacgagggcttgctagtctcctaagttagtctgctaataaatgttaaccctaataactgaaattattagcagaggtaattatccagttctatatcaaggcaaaaagacagcagtggatagaaagatcttagaagtcccactaggttcatccaagccaccatacacataggcagaaaa

SEQ ID NO: 139 - DNA, 426 bp, Homo Sapiens
  allele 285: 2-48-285 : polymorphic base A or G
  misc_binding 265..284: 2-48-285.mis1, potential
  misc_binding 286..305: 2-48-285.mis2, potential complement
  primer_bind 1..24: upstream amplification primer
  primer_bind 404..426: downstream amplification primer, complement
  misc_binding 273..297: 2-48-285 potential probe
gttttattttattgatgggctgtctggctccctcaactacaaagtaaactccacaaaggcagagagttttgcctcttttattcattgctgtacctgcatcacttagaaagtttctggcacctaggaagtgttcagtaaatatttattgaataagtttatgtaaaacgtctcagactccttagagaaactggtcttttggggttggagaataaagttctttacctcatcagttagactctatctaaggtacacgagggcttgctagtctcctaagttagtctgctrataaatgttaaccctaataactgaaattattagcagaggtaattatccagttctatatcaaggcaaaaagacagcagtggatagaaagatcttagaagtcccactaggttcatccaagccaccatacacataggcagaaaa

SEQ ID NO: 140 - DNA, 420 bp, Homo Sapiens
  allele 167: 2-49-167 : polymorphic base A or G
  misc_binding 147..166: 2-49-167.mis1, potential
  misc_binding 168..187: 2-49-167.mis2, potential complement
  primer_bind 1..20: upstream amplification primer
  primer_bind 396..420: downstream amplification primer, complement
  misc_binding 155..179: 2-49-167 potential probe
aagtcccactaggttcatccaagccaccatacacataggcagaaaaatcaaaataagatatgagcctggacagggtgagcaatctgggaaaagatgaacacagtatgctaggacccagaaatcatcaagtctatgaaaactaagccagaacacaaatgtgaattccrtaagatcaggaacataatctgtcttgttcatccaggcatggtaatctgccagaaatagtgcttaactgcaagaactgaatatttgttagataattaaaccatcaactaaatgagattcatgcaaccatgaaaaatgctgctataggtacacaatattgatatactagaaagttaaaaaatcaagttggaaattagactattccatttctgtttgtgtgtatgtatctacaaataggtggaakgatataccaaa

SEQ ID NO: 141 - DNA, 1001 bp, Homo Sapiens
  allele 501: 10-436-43 : polymorphic base G or C
  misc_binding 482..500: 10-436-43.mis1
  misc_binding 502..521: 10-436-43.mis2, potential complement
  primer_bind 459..476: upstream amplification primer
  primer_bind 859..878: downstream amplification primer, complement
  misc_binding 489..513: 10-436-43 potential probe
  misc_feature 297,539,629,650,976..1001: n=a, g, c or t
tatatttaatacatatatttaataaaaacattaaatacatatatttaataaaaatataatttatatataatatacatatatttatatataaatatatttatatataatatgcatatgtttattttacatatataaatatatttatatataaatatacgtatatttattttatatatatatgtgtgtgtgtatatatatatatacacacacacacgtatatacccagggagaggcactaattgtgcagttttgaaaagtttcctagtgatgctgccgtggcctactttcaaagcactntgcttaggtttaccacttaaaatgttattacatttttccagaagtacactttaaaatactttgtttttaaagtgaggcattacaatggtgtcatgagctgacattcccagccactgactggaagatttgggtcaacccagggaacaggcttggtttaagggagttcaagtgttggtggcctttgggtaaaagtttatgtctatstttgtatgtgggattcagtagggattttctttaatgtntaaaaattctagtttcctctgtatttgctttccttcttcccctgtcctccctgagcctccacacatgtgtaacacattttatttgccaantaggtcaaggaggttaaaaangactttgtcgggcttggaagtcagcatggttactgcagttcccggtaggctaccagtcatgaccatgattccagatgttgactgcctgctctgggccattgggcgggtcccgaataccaaggacctgagtttaaacaaactggtaagctggcttggtctgcccgaaacatttgtgaatctactgggagtcttatggttttattttccccccagacacccaaaacttgggtggattccattggattcttttctctttttcccatgtattcagtttgtgatcaaatttcattgcttcttcctttgaaattaaaaaaaaaagttttctnnnnnnnnnnnnnnnnnnnnnnnnnn

SEQ ID NO: 142 - DNA, 1001 bp, Homo Sapiens
  allele 501: 10-436-376 : polymorphic base A or G
  misc_binding 481..500: 10-436-376.mis1, potential
  misc_binding 502..520: 10-436-376.mis2, complement
  primer_bind 126..143: upstream amplification primer
  primer_bind 526..545: downstream amplification primer, complement
  misc_binding 489..513: 10-436-376 potential probe
  misc_feature 206,296,317,643..685,853: n=a, g, c or t
tccagaagtacactttaaaatactttgtttttaaagtgaggcattacaatggtgtcatgagctgacattcccagccactgactggaagatttgggtcaacccagggaacaggcttggtttaagggagttcaagtgttggtggcctttgggtaaaagtttatgtctatgtttgtatgtgggattcagtagggattttctttaatgtntaaaaattctagtttcctctgtatttgctttccttcttcccctgtcctccctgagcctccacacatgtgtaacacattttatttgccaantaggtcaaggaggttaaaaangactttgtcgggcttggaagtcagcatggttactgcagttcccggtaggctaccagtcatgaccatgattccagatgttgactgcctgctctgggccattgggcgggtcccgaataccaaggacctgagtttaaacaaactggtaagctggcttggtctgcccgaaacatttgtgaatctactrggagtcttatggttttattttccccccagacacccaaaacttgggtggattccattggattcttttctctttttcccatgtattcagtttgtgatcaaatttcattgcttcttcctttgaaattaaaaaaaaaagttttctnnnnnnnnnnnnnnnnnnnnnnnnnnnnnnnnnnnnnnnnnnntctttttgtttttgagaaaggtcttgctctgtcacccaggctggagttcagtggtgtgatcatagctcaccgcagtcttaacctcctaggctcaagtgatccacccacctcagcttctggagtagatggaactatgtgtgtgccacaatgcccagctaatttttttanttttattttttttagagatgaggtttcaccatgttgcccaggctggtctcctcggctcaagcgattcgcccatctcagcctcccagagtgctgggactataggcatgtcccagcatgtcccagaaaaaggccgccacgtctggccttt

SEQ ID NO: 143 - DNA, 1001 bp, Homo Sapiens
  allele 501: 10-431-51 : polymorphic base A or C
  misc_binding 482..500: 10-431-51.mis1
  misc_binding 502..521: 10-431-51.mis2, potential complement
  primer_bind 451..468: upstream amplification primer
  primer_bind 853..872: downstream amplification primer, complement
  misc_binding 489..513: 10-431-51 potential probe
agcatcccttatctgaaatgcttgggaccagaagtgttttcagtttcagattttggaatatttgcatatatataatgagatattttgcagatgcgacccaagtcgaaacacggaattcatttgttttacatacaccttatacacatagttggaaggtaactttatacgatattttaaatgtgtgcatgaggcatacttttgtctgcgtttttgactgcaacccttcacatgaggtcaggtgtggaattttctgcttgtggcatcatggtgctccaacattttggattttggattttgaatttctggattagggatgctcaacctgtaatagaatgtataggattctcataagccaatcattttgagttgttcgctgaggcatgacatatcttcgctgtattaaactatctagatagtgtaatgaacaatggtgtgaaactgtcagaactagggcattaaggtagatggataaatggctagtggaacaatttagctatgttmaaacagacagtaagataaacactgattttaaaatatctccatagttgcaatagctgctggccgaaaacttgcccatcgactttttgaatataaggaagattccaaattagattataacaacatcccaactgtggtcttcagccacccccctattgggacagtgggactcacggaaggtaggtatttaaaaactgaaggtcatttgtggtttccttcctctttcccctgcccccaactttaaattaggtctctgtcagctgatgaaacctatctcagccccagattacattgctttttggttactctcttgtcacagttccagttttctcccctgctactactttgagtgtacagtatctttccttcacaccaccctatctctttgatcttttttttttagcttttttatttgaactaattttaaatttaaagaaaagctctaaaaataatacaaaggactcctctctaaccttaatatttttgcttttttattttttcac

SEQ ID NO: 144 - DNA, 980 bp, Homo Sapiens
  allele 480: 10-432-93 : polymorphic base A or G
  misc_binding 460..479: 10-432-93.mis1, potential
  misc_binding 481..499: 10-432-93.mis2, complement
  primer_bind 388..407: upstream amplification primer
  primer_bind 758..775: downstream amplification primer, complement
  misc_binding 465..489: 10-432-93 potential probe
  misc_feature 297,477,629: n=a, g, c or t
acacacacacatgtctatctttcctaagaactggcccttacataaaccgagtatcattttctttttttttttctttttgagacaagctctcccactgtcacccaggctggagtgcagtggcacgatctctgctcactgcaacctccgcctctgggttcaagcaattcttctgcctcagcctcccgaatagctgggactaccaggcctgcaccaccaccatgcctggctaattttttgtagagatggggtttcactgtgttgcccaggctggtctcaatctcctgggctcaagcgatnccacctgcctctgcctctcaaagtgcagggattacaggcatgagccactgtgcctggcctttcttttcatctagaggcagaattcctcagcccttcttttgtcttatatgacactgacatttattttgtagaatacttctcattttggcgtggtttgatatttcctcgtggtttgattgnagrttatgtatttctggtcatctccctctttgatagttcagtgtaattgtttagttttctgatagatgctttttttaatgtgcattgtagatgaagccattcataaatatggaatagaaaatgtgaagacctattcaacgagctttaccccngatgtatcacgcagttaccaaaaggaaaacaaaatgtgtgatgaaaatggtctgtgctaacaaggaagaaaaggtaaggaaaaatccagcaaactaaatagtgccttgcaaaatggacagggatggcagtattttgcaggggtggaaaggagggagaccaagcagttgagccttctgattcaactggacaggcccactttgatctgtcttacctgcattttggggttcttcataatatttcatctagaaggaggttccactccttttaaaaaataaagacgatgccaggcgtggtggctcacacctgtaatcccagcacgctgggaggccgaggcaggcatatcacctgag

SEQ ID NO: 145 - DNA, 933 bp, Homo Sapiens
  allele 433: 12-631-208 : polymorphic base A or G
  misc_binding 414..432: 12-631-208.mis1
  misc_binding 434..453: 12-631-208.mis2, potential complement
  primer_bind 226..245: upstream amplification primer
  primer_bind 705..725: downstream amplification primer, complement
  misc_binding 421..445: 12-631-208 potential probe
  misc_feature 30: n=a, g, c or t
gcaggcctgtaatcccagcactttgagagnccgaggcaggaggatctcttgaacccaggagttcgagaccagcctgggcaacatagtgagaccctgtctctaaaaacaaaacaaaaaacttctcagcctaaattctcacaagaccttcatcttatcaacctgtttatttccttttcagtgttcgccaggatgcgaaagcactgtctatgattgcccctgtgctctttgcctctaccctcttacacgtaaaaccatcacacctggagggaaaaggttcctcgaagtgaagtcagctccggaagtgggggggcaggggcgatgcagtctgggagttgtagtcaaagctgctccgaagccacgcagccgaagaggcggtcgttctatgcaacattcctgtgaaaattacccagctgtgactgtcgaagggaaaaartcacacttacctatatccgggatcccacgccggagctccagacacacaagggggacagcagagaggaagaaaatgccaacaaccccacgtgaagccatggtggcggaagcgcctggtgcaggcggaaagcccgccccttccggccgcgttttccgggaaggaagtggaactcttcttgccgcgggccggctggagagggtcaataacgtggtaaatactgacggccgtgtcgttattgagggggagctaagccccgtgttttaaagttatagtctgtagccgtgtttcagaagaaaggcaagtcgtcccccaagtcacatgatgtccagaggagcctgggctctagagcggtggctccctggagggtagcagggcaggggctgccccttcggtctttgcagcgtctgtgagaaagcgctttccagagggaaatgaagccgaagaaaaagctgatgctgtgaggaggcagcctgggccccccggccttgtggccgtatagg

SEQ ID NO: 146 - DNA, 1001 bp, Homo Sapiens
  allele 501: 10-260-282 : polymorphic base G or T
  misc_binding 481..500: 10-260-282.mis1, potential
  misc_binding 502..521: 10-260-282.mis2, potential complement
  primer_bind 220..238: upstream amplification primer
  primer_bind 636..655: downstream amplification primer, complement
  misc_binding 489..513: 10-260-282 potential probe
tatcttcctcacagggctgaatgatgaatctatgtaaagtatttaaaatagtaccttgcacatagtaagtgctcaataacttgtgggtttctttttgttatttgcattttgcttttttgcttctctctcttcaatacgtagagataaactatcacagaatctggaagctctctgggttccactctcccccttccactctcccaaggtaaccactaatctacagttggtgtgtcctcagtaaatataggccagactttccatgggattccatttgcaggaagacaacccgttcacaggtgccctacccctgtcccattctctcttcttgatcacaggtggtgagctatgccccattcacgctcttcccctcactggtccccagtgccctgctggagcaagcctatgctgtgcagatggacttcaacctgctagtggatgctgtcagccagaacgctgccttcctggagcaaactctttccaggtaggggacagtgaagcatkggggggccaggagctgccagagccaaggaactggaagattgcagagccgtgaggtgttactgtgtcagctgacttggtgggatagaggaaaggtacctccaaagaacaaaaagtcataggagtcaggaaagctggcttctaatcctggctcgaccagttatttatatggcctcaagccactccctttccttctctgggcctaaggtttcttcatctgaaaaatgaagagactggcttaaatccaagatcccttttattgttgacattctgtaatccgtgacaccctactttgaagactgatatttccatttggaattaggggaagtcagcctggttttggaggaaaacagaggtagggaaggttattgggttaaagtcagattttctacttctcctaagcagcgacactttcttgtcacctcaggcctctcatctttggatgggatggggtacagactgggccacactcagggcatgaggaagcaacctctgaaatggtt

SEQ ID NO: 147 - DNA, 1001 bp, Homo Sapiens
  allele 503: 10-263-26 : polymorphic base A or C
  misc_binding 483..502: 10-263-26.mis1, potential
  misc_binding 504..523: 10-263-26.mis2, potential complement
  primer_bind 478..496: upstream amplification primer
  primer_bind 820..837: downstream amplification primer, complement
  misc_binding 491..515: 10-263-26 potential probe
ggcatacctgtggggtgacatgctgatgggtgtacagtcactggctaggccagggaactccagctatgattgtgctttcctgggccccgggtcacatgttgcccctggccaccccgacagcagtttccacttgtaatgagatccttggtatgtcagggagaaaaaggacctcatagctcatctagtcctgtccctccattgtacaggcagagggaacaatatcttgagagccccagagagaggaatgcagggacttctgtctgggggctgggcctggtagcatccatttctagccagcagtgatgctccaggttgcaatgattttagatggtctgcagcaggattccagacagcacctggaggcccagagtaaggggctccagctcactgggacactagggtaggttggggtggggacagaggctctcaggtctcctccaggcatatacaccaggggccaaggttagggcagcccagcatattccaacctgaagtggatcttmcaggaatgtgatgggaggatgctttttagtgctcagctgattctcagagtcatgttgctgtatatatgaggtcatgggcagaggggtcttccaggtccatccaattactgaacagccatctctcttccaacagacatgttctcagtgtcctgagtaagaccaaagaagctggcaagatcctctctaataatcccagcaagggactggccctgggaattgccaaagcctgggagctctacggctcacccaagtaagggtgtgaaaaggtagcaggaggatcctgctttagtttcagcattcatgggtttagcaacttcttttcttgccagccatcattagagaataaggggatttttctaggaatagaaacttatacctttacatgccaaaattattttaaggtttccttcttaaataacagatgctgactatgatttaactttttcttattgagtggaggtcatcattatgactgtcaacaattgcagcttgctgtaa

SEQ ID NO: 148 - DNA, 981 bp, Homo Sapiens
  allele 501: 10-258-408 : polymorphic base A or G
  misc_binding 481..500: 10-258-408.mis1, potential
  misc_binding 502..521: 10-258-408.mis2, potential complement
  primer_bind 95..112: upstream amplification primer
  primer_bind 504..521: downstream amplification primer, complement
  misc_binding 489..513: 10-258-408 potential probe
tcctgaggggtatcctcctaaagacctccaaagtttttatggaagggtaaatactggtaccttcccccagctttccatctgaggaccagaaaagttgtgtctcccttagatgagatctagacgcccccaaatccttgagatgtgggtatagctcagggtaagctgctctgaggtaaaggtccatgaaccctgccccactcctgtcagcccctcatcagccttttcagcaggttccagtgcctgacttgggataggactgagtggtaggaggagggggagtggaggggcatagcctttccctaattctgccttaaataaaactgcattgctgattcagtgatgattccttacttcgtgcatagaggggaggcgggagctgtaatctacgttagcccacttaagatgtattagagcagggaagtgactggtctgtaatcagggtccccctagaccagtctctacaggtggaaccctgaagtttcaatccttagccacccactratgctcttactggatcacagggaggaatgagagtccctggcaggagcccaggagggaaggcaaccaagatgggacatacataacagttgtgaactggcttcagtcactttcctgcttagctcaggggcttgtcaaaggccctgtcagtgaagcctccttcgctctgcccaaaccaaaagttctagaaggaagatattggggatagtcctaggaaatacccctcccttcccatctgccacacaaatcagagccactaatgaatatacagcctcagggcacagatacctaagaaaacaagtcaccacttcttgagatcacaggctttattcctacaaccacagggcttgagcctgactggggcaagaaaacagagtttcatctgagaatgtctcttatgggctgggttctgttcaggggagggtgggaacagaggacaaggaagacaagctcctctggccctaggaacaaaacacatttact

SEQ ID NO: 149 - DNA, 1001 bp, Homo Sapiens
  allele 501: 12-317-259 : polymorphic base G or A
  misc_binding 481..500: 12-317-259.mis1, potential
  misc_binding 502..521: 12-317-259.mis2, potential complement
  primer_bind 742..759: upstream amplification primer, complement
  primer_bind 297..317: downstream amplification primer
  misc_binding 489..513: 12-317-259 potential probe
  misc_feature 426,432,443,459,841,849..850,898,914: n=a, g, c or t
gtcacaaaagatggcatattgcatgagttcattaatatgaagtgtcctgaacaggcaattgcatagagatggaaaatagtttcatggttgcctagagctaaggagtttggtgggaaataggaagtgactggtagtgagtacaaggctgcttttggggggtgatgaagatattctaaaattgattgtggtaatggctgcacaactctatgaatgtcctaaaaatcacgataccatggttaactaaatgggtgaattgcatggtatgtgaattgtacctcaaagctgttaaaaaaaaaaaaaagtgagtgtgcatgtccgcagaaaacagtgcagtgcagacagagagtggtgaccgctccaatcggtgtggtagagctgaagagactcaggggagcacaggcctcgtgagctggttttcccatcctncatccnttgggactganccttgttgctaagctnctggccattgctttggagactgtttcttgaaaatatttatcrcagaaagtcttgtcaggcctgcgcaagccaggcaccaaaagttggtggtgacttggagaggggtcaggctgccctgtctctttcttcgcagacgttcatttctcagtaggacttgtgtgccccacactgtgcccactgcttgcataaacatccttccctgcaggactccctagagcaccatgggctgggtgccgaggatgccaagcacgcaaggtctcacagcagtgcacgacagaggcaggattctgcgtgatagttcttcaggttcacttcacagattagctgacacttaactgttctggaagctgggccaaggagtgctaacatggaaattgagtanactatagnnttttttgcccaaggtacaggagaataaatatgagtagatagaatctcnttaaattaaaaatttnctccagtaaatttttcctaagtctttgcctcctgcctgtttagttcccattaaaagcttggagatgaaaaagaatacaaagtaacaa

SEQ ID NO: 150 - DNA, 1001 bp, Homo Sapiens
  allele 501: 12-323-385 : polymorphic base T or C
  misc_binding 502..520: 12-323-385.mis1, complement
  misc_binding 481..500: 12-323-385.mis2, potential
  primer_bind 868..886: upstream amplification primer, complement
  primer_bind 416..435: downstream amplification primer
  misc_binding 489..513: 12-323-385 potential probe
  misc_feature 303,710: n=a, g, c or t
agtaaattcttggccagccacagtggctctcatgcctgtaatcccagcactttgtgaggccgaggtgggcagatcacttgaggtcaggagaccagcctggccaacagggtgaaaccctgtctctactaaaaatataaaaattagcccagcatggtggtgcatgcctgtagtcccagctacttgggaggctgggacagaaaaattgcttgaacccaggaggcagaggttgcagtgagcagagattgtgccattgcgctctggcctgggcatcacagtgagactccgccttaaaaaaaaaaatcnttaaaatttaagacaaaacaaaaaaccataagaagtgggctgggggtggtgggacctgttttgggaaccatatactgagttagacagggctagaggaactggtgagctacaagttacagttgccaataatagtagtagcttacatttgttttgtactagggaaaaggaaaagtggaagcagttgttccccaatgcccyctgcacagcaaattcctgtcctccattactagaaatagaggcgagtatgggattcatgagagcttctaggaatcatgcactcgttttgggcacattcactgatacccttgctaccaggtcctgtgcattgagtctcaggagaaagggtaggatatatgccttcatcaaagtatggtcagattatttgggaaatagatgcaggaacaganttattaaaagttcatgtgatctgtgcagtgaaagagaaacacccaatccagtggaagtaaattagtgggatgaaggatagcaggtgttatctgagtagcacggggatggttcaaaatgagaaaagttgatgtagtacatgccatttacagattttaaggagtaatgagtgagaatagaaccaaatagcacaaggcattccataaaattatcattcttaataaaagctagcaatagaaggaaaacttataaactatatatagggtatttattaaaatttaacttataggata

SEQ ID NO: 151 - DNA, 857 bp, Homo Sapiens
  allele 357: 12-324-219 : polymorphic base C or T
  misc_binding 337..356: 12-324-219.mis1, potential
  misc_binding 358..377: 12-324-219.mis2, potential complement
  primer_bind 139..157: upstream amplification primer
  primer_bind 579..599: downstream amplification primer, complement
  misc_binding 345..369: 12-324-219 potential probe
  misc_feature 442: n=a, g, c or t
attaaagtgttgaacaaggcagcaaagccaattgccctggaagccgccaccttgaggccggccacgtgggcatctggtgcagctccctcagtcattcttgtctccctgctggagacagggtgtctgatgccagcattcttaccctgcatgacttgccttgacagcctgcctttcatgtacctttcatatccacctggttttcaaatcggtccagggacagagtgacacagcgcaccagcatgttggagtccaccagggagctgttgatctgcttcaggaatacctggaactatacagaaaccaagctcacagcaggcagtgggctgctggccaggtatggccatggcccggggggayagtcactacaaggggcatcagcgacctctaccagccccactgcttcagataggaagacagaggctcagataagctgagggacctncccctcaccacccaggtactaagaggcactccccggaattcagcacagatccgacactctctccagtggttttacgctcaagggtgctggattcctttaatttttacttttaattttacttcagctagcctgagctgggtttctgtcacacacactcggtgagcctaacacaccaggcccagtccctccctacagcggctcccaccgtggcacccaccatgctgcgtcacggcaggcgcacaagccacccattcccaccctcactccctacccacaagcagccccggttttcatccctgcattcccagggtctagcacaaagccagacagagcaggttccaatgaatgtttgccaaagactgcccagactcccccgtcgtctctaacgtaaaacctgtgcctaaagcctggcaga

SEQ ID NO: 152 - DNA, 973 bp, Homo Sapiens
  allele 473: 12-324-335 : polymorphic base G or C
  misc_binding 454..472: 12-324-335.mis1
  misc_binding 474..493: 12-324-335.mis2, potential complement
  primer_bind 139..157: upstream amplification primer
  primer_bind 579..599: downstream amplification primer, complement
  misc_binding 461..485: 12-324-335 potential probe
  misc_feature 442: n=a, g, c or t
attaaagtgttgaacaaggcagcaaagccaattgccctggaagccgccaccttgaggccggccacgtgggcatctggtgcagctccctcagtcattcttgtctccctgctggagacagggtgtctgatgccagcattcttaccctgcatgacttgccttgacagcctgcctttcatgtacctttcatatccacctggttttcaaatcggtccagggacagagtgacacagcgcaccagcatgttggagtccaccagggagctgttgatctgcttcaggaatacctggaactatacagaaaccaagctcacagcaggcagtgggctgctggccaggtatggccatggcccggggggatagtcactacaaggggcatcagcgacctctaccagccccactgcttcagataggaagacagaggctcagataagctgagggacctncccctcaccacccaggtactaagaggcactscccggaattcagcacagatccgacactctctccagtggttttacgctcaagggtgctggattcctttaatttttacttttaattttacttcagctagcctgagctgggtttctgtcacacacactcggtgagcctaacacaccaggcccagtccctccctacagcggctcccaccgtggcacccaccatgctgcgtcacggcaggcgcacaagccacccattcccaccctcactccctacccacaagcagccccggttttcatccctgcattcccagggtctagcacaaagccagacagagcaggttccaatgaatgtttgccaaagactgcccagactcccccgtcgtctctaacgtaaaacctgtgcctaaagcctggcagaccaggactccaggtgaacttctggacaacccagcacactccacagagccctgggttaactttacctttgcatcggtgttgatatatttattgaatctcttgaatgcatcaacgttg

SEQ ID NO: 153 - DNA, 1001 bp, Homo Sapiens
  allele 501: 12-324-380 : polymorphic base A or G
  misc_binding 481..500: 12-324-380.mis1, potential
  misc_binding 502..521: 12-324-380.mis2, potential complement
  primer_bind 122..140: upstream amplification primer
  primer_bind 562..582: downstream amplification primer, complement
  misc_binding 489..513: 12-324-380 potential probe
  misc_feature 425: n=a, g, c or t
ggcagcaaagccaattgccctggaagccgccaccttgaggccggccacgtgggcatctggtgcagctccctcagtcattcttgtctccctgctggagacagggtgtctgatgccagcattcttaccctgcatgacttgccttgacagcctgcctttcatgtacctttcatatccacctggttttcaaatcggtccagggacagagtgacacagcgcaccagcatgttggagtccaccagggagctgttgatctgcttcaggaatacctggaactatacagaaaccaagctcacagcaggcagtgggctgctggccaggtatggccatggcccggggggatagtcactacaaggggcatcagcgacctctaccagccccactgcttcagataggaagacagaggctcagataagctgagggacctncccctcaccacccaggtactaagaggcactccccggaattcagcacagatccgacactctctccagtggttttacrctcaagggtgctggattcctttaatttttacttttaattttacttcagctagcctgagctgggtttctgtcacacacactcggtgagcctaacacaccaggcccagtccctccctacagcggctcccaccgtggcacccaccatgctgcgtcacggcaggcgcacaagccacccattcccaccctcactccctacccacaagcagccccggttttcatccctgcattcccagggtctagcacaaagccagacagagcaggttccaatgaatgtttgccaaagactgcccagactcccccgtcgtctctaacgtaaaacctgtgcctaaagcctggcagaccaggactccaggtgaacttctggacaacccagcacactccacagagccctgggttaactttacctttgcatcggtgttgatatatttattgaatctcttgaatgcatcaacgttgaacttcatcagctcccccaggaggtcaaagtaactctggagcaca

SEQ ID NO: 154 - DNA, 1001 bp, Homo Sapiens
  allele 501: 12-325-30 : polymorphic base C or T
  misc_binding 481..500: 12-325-30.mis1, potential
  misc_binding 502..521: 12-325-30.mis2, potential complement
  primer_bind 472..491: upstream amplification primer
  primer_bind 926..945: downstream amplification primer, complement
  misc_binding 489..513: 12-325-30 potential probe
ctttgggaggtggaggcgtgtggatcacaaggtcagaagatcaagatcatcctggctaacacggtgaaaccccgtctctactaaaatacaaaaaattagccaggcgtggtggtgtgtgcctgtaatcccagctactcagggaggctgaggcgggagaattacttgaacccaggaggcggaggttgcagtgagccaagatcgagccactgaactccagcctaggcgactgagtgagactccatatcaaaaaaaaaaaaatacaaagcctcaacccctccttcccatcaggcctcttgcatcagagtctctgggatggggcccaggaatctgtattctttcccagctccccagaatgttcagccaggtttggaaactgatctatccgattcttcttgtttcacagttagggaatctgtagctctgggaagggaaggaacttgccccagtcacatctgatattagtgcttctttctccaatgaagagcctttaggctgggagtycagagacatgggttcaagtccaggctataccagtcatcacctcgggcaagtcatttcacctctccaagcctctgcttccttactgtgagaataatgccattgtgttgggaatcaaaagagagagtggcaatggaaatgctttgtcaagctttctattttgtgcacatggaagttgttaagagctagaaccagccagtgttcactcctgtataccacgctgttcccttccaacagaggtcagggtcctgctgtgttgggggtggccgccagccagtttcggtggttgctgggcttcaggccatctgttaccaactctcttctctccatcttttgcaggtgttgggatggccaccaactgggggagcctcttgcaggataaacagcagctagaggagctggcacggcaggccgtggaccgggccctggctgagggagtattgctgaggacctcacaggagcccacttcctcggaggtaagcccctagctcctccccacagca

SEQ ID NO: 155 - DNA, 999 bp, Homo Sapiens
  allele 479: 12-327-31 : polymorphic base G or T
  misc_binding 459..478: 12-327-31.mis1, potential
  misc_binding 480..498: 12-327-31.mis2, complement
  primer_bind 449..468: upstream amplification primer
  primer_bind 982..999: downstream amplification primer, complement
  misc_binding 467..491: 12-327-31 potential probe
  misc_feature 758: n=a, g, c or t
tgtcttaaaagctagtttttcaatgttaacaggctggaaatattgttaatacaaaaacctatcactgtgtaccttatggtacaccaaataaacaaggtaaaattatacaaatgtatcattaaaaagcagcagtagaaaaccatgaccatgcagaggtagccctaatcatgctctgaaaacagttctttgtttctaaagtccagttgtgtgcattccccaggctggctctgcagagttatcaagtgcttcagagcagcctcctctcctgaggctgaatatgaacctgccattcactctgttattgtctagttttagttaggaacatgaggtgatcataactatactttgtaggttattagggaatataattttacatgttgtagtcatatgtaaaggtagaagtttgtggactccaaccccagtttattctctctctagatttgcttttcctcctgtgtcactagatacaaggtcttccktggtctgtgtacggttttcttcccactcctttatgattttgggggagttctcattttaggaaatttacatttttaaaaaatatgtgactttccaacatggcacatatatacatatgtaacaaacctgcacgttgtgcacatgtaccctagaacttaaagtataattttaaaaaaagtgactttcattataactaaattatacctcagagctggtgtacacacctccatatacattgacaaaaggtagtatttgctaagctcctggtatgtggcaaacgnctgggtaactgctttacctagaagtgattttatttaatccttcaagtgccctgtggaatagagattagtatccccattgcacatgtgaggaaactgagggctagaaaggttctgtattggatgcctgtgtatgccgaggcactaagtaactttcatcttttagtttcccatttaaggaatctattctggcagatgattttgatcctgttagtattgattgcttgcttcagatgcctatttg

SEQ ID NO: 156 - DNA, 1000 bp, Homo Sapiens
  allele 500: 12-327-415 : polymorphic base A or G
  misc_binding 480..499: 12-327-415.mis1, potential
  misc_binding 501..520: 12-327-415.mis2, potential complement
  primer_bind 86..105: upstream amplification primer
  primer_bind 615..633: downstream amplification primer, complement
  misc_binding 488..512: 12-327-415 potential probe
  misc_feature 395,958,975: n=a, g, c or t
tataattttacatgttgtagtcatatgtaaaggtagaagtttgtggactccaaccccagtttattctctctctagatttgcttttcctcctgtgtcactagatacaaggtcttccttggtctgtgtacggttttcttcccactcctttatgattttgggggagttctcattttaggaaatttacatttttaaaaaatatgtgactttccaacatggcacatatatacatatgtaacaaacctgcacgttgtgcacatgtaccctagaacttaaagtataattttaaaaaaagtgactttcattataactaaattatacctcagagctggtgtacacacctccatatacattgacaaaaggtagtatttgctaagctcctggtatgtggcaaacgnctgggtaactgctttacctagaagtgattttatttaatccttcaagtgccctgtggaatagagattagtatccccattgcacatgtgaggaaactgagggctagraaggttctgtattggatgcctgtgtatgccgaggcactaagtaactttcatcttttagtttcccatttaaggaatctattctggcagatgattttgatcctgttagtattgattgctttcagatgcctatttgtaaactgacttaagtaaaaccagcattacccattattcttgaggaatgaactgttctggtcagctgggcttttttgattaactgagaacggaaagcccagtttttgtttttgtttttttatttgggagttttttcttaaagtctctataaaataatctagattcactttcatatctgtgtgactagcctagtagacagtctatgtgtgattctgcttgtagcttttgggataaagcctaaaagttgtagttccacacatgaggttgtgcaggatctgacccttcccaaccctgaccataattcctactccattcccttacccgcnacgattttctccattcnaaatgccctgggaaggccaagctgg

SEQ ID NO: 157 - DNA, 1001 bp, Homo Sapiens
  allele 501: 12-331-270 : polymorphic base G or A
  misc_binding 481..500: 12-331-270.mis1, potential
  misc_binding 502..521: 12-331-270.mis2, potential complement
  primer_bind 751..770: upstream amplification primer, complement
  primer_bind 285..305: downstream amplification primer
  misc_binding 489..513: 12-331-270 potential probe
aactacggcttgggaggtgtactaagccaagggccagaacacaaaatcaggtcctaacactaagtgccatcctcttttgtttctaccagattgctttctttattcaccattcttcctggctcagtggtcaacctagtagagtcctgctcaatatatgggcggggcttctggttctcattttgttttctaacaaggaaaatgaagaaataggcataatggagttaaaatgagtcttaaaggtcacagtctgccaacacttgtcaccttttgacaagtgtccagtttctacttggacagctctaaggccaaaggagtttactacctgctgcagcagtcctggctcttaacaactgctacaaaattctgcctccccgtaatttctaccagttagtcctgattttcaggcacacataaaataagcccgattcccccactgtctgaaagcagctcttatgtctgccattctactcgaatattcccatcttaaacattgcagacctrgtaggggagataaacagagccccagtggcaggggtacttacacagacacaggtattatacaggatactcaagcagtccttggacatttcatcacttactgaaagtgaaagggtaatgactggttatttttctcaatgaaaagatagtacaacagttaccacatttttttcagcataagaactgttataatcccctccaagatgattatttttcctttaatatacttcttccagcccctgtctaccaaaggttttcatagtgcccatcagaacctacaagcccatttgcatattgcttttggtttgatacagcagctgttttcttattatgctccacagtcttcataatttcaacctgttgttgtgccatcatttaataaagccattttcccttaatgtcttgcttaggatatatctaggatttgttttttttgttttttgtgttttttggctatttaagtagaccacaaatgaacaacttaatatatatgtgtatccttt

SEQ ID NO: 158 - DNA, 1001 bp, Homo Sapiens
  allele 501: 12-331-275 : polymorphic base T or G
  misc_binding 481..500: 12-331-275.mis1, potential
  misc_binding 502..521: 12-331-275.mis2, potential complement
  primer_bind 756..775: upstream amplification primer, complement
  primer_bind 290..310: downstream amplification primer
  misc_binding 489..513: 12-331-275 potential probe
taagaaactacggcttgggaggtgtactaagccaagggccagaacacaaaatcaggtcctaacactaagtgccatcctcttttgtttctaccagattgctttctttattcaccattcttcctggctcagtggtcaacctagtagagtcctgctcaatatatgggcggggcttctggttctcattttgttttctaacaaggaaaatgaagaaataggcataatggagttaaaatgagtcttaaaggtcacagtctgccaacacttgtcaccttttgacaagtgtccagtttctacttggacagctctaaggccaaaggagtttactacctgctgcagcagtcctggctcttaacaactgctacaaaattctgcctccccgtaatttctaccagttagtcctgattttcaggcacacataaaataagcccgattcccccactgtctgaaagcagctcttatgtctgccattctactcgaatattcccatcttaaacattgcakacctggtaggggagataaacagagccccagtggcaggggtacttacacagacacaggtattatacaggatactcaagcagtccttggacatttcatcacttactgaaagtgaaagggtaatgactggttatttttctcaatgaaaagatagtacaacagttaccacatttttttcagcataagaactgttataatcccctccaagatgattatttttcctttaatatacttcttccagcccctgtctaccaaaggttttcatagtgcccatcagaacctacaagcccatttgcatattgcttttggtttgatacagcagctgttttcttattatgctccacagtcttcataatttcaacctgttgttgtgccatcatttaataaagccattttcccttaatgtcttgcttaggatatatctaggatttgttttttttgttttttgtgttttttggctatttaagtagaccacaaatgaacaacttaatatatatgtgtat

SEQ ID NO: 159 - DNA, 1001 bp, Homo Sapiens
  allele 503: 12-334-320 : polymorphic base A or G
  misc_binding 483..502: 12-334-320.mis1, potential
  misc_binding 504..523: 12-334-320.mis2, potential complement
  primer_bind 184..202: upstream amplification primer
  primer_bind 616..634: downstream amplification primer, complement
  misc_binding 491..515: 12-334-320 potential probe
ccagcctgggcaacagagtgagactccatctcaaaaaaaagaaaaggataacgtgatagacttatagggtggggcagcctccagggatgaaacatctgaatgaccaaaggagccagtcatgccaggattttggaggaaagcacccaggcagagagtgcagaaagggcaaacgctccctggaaagattcttagtcaagagtccttcactcccagtcctaccacaaactgggtcaccttgaacaagtcacgtaacttctgaggctcagctgccacatctacaaaatgggaataaagacatcttacctgccacattgtgagaggtttcaaccaaagggctgttaaggtctgggatcctccccaaatctcaccatagacacctgatactcatcacttggcacccgtcttggaagaggggaacctgcacagagaaccctgggtcatgcttttgatttttaatttcatgctgcactagaaatagcttcttttgttcctggttgacccargagcctcttcctgccacctggggcctattctagttaacagctgcttatcccctcaggtacaaaagccaacaaggaaaggacatcaggaaacattgttctgggaataaccagacacctatctgccaccatctccccccatcccgtgaccacacacgggagactggaggactcagcctgtcctgtagtcagataatgtacatggtttatttaaagagtcaaaaggggccgggcgcagtggctaacgcctgtaatcctagcactctgggaggctggggtgggtggatcacctgagctcaagagtttcagaccaatctggccaacatggtgaaaccctgtctctaccaaaaatacaaaaattagccgggtgtggtggtggacgcctgtaatcccagctacttgggaggctgaggcaggagaattgcttgaacctgggaagtggaggttgcagtgagctgagatcgtgccactgcactccagcctgggcaacaacaacgaaaa

SEQ ID NO: 160 - DNA, 1001 bp, Homo Sapiens
  allele 503: 12-334-391 : polymorphic base A or G
  misc_binding 483..502: 12-334-391.mis1, potential
  misc_binding 504..523: 12-334-391.mis2, potential complement
  primer_bind 113..131: upstream amplification primer
  primer_bind 545..563: downstream amplification primer, complement
  misc_binding 491..515: 12-334-391 potential probe
gggcagcctccagggatgaaacatctgaatgaccaaaggagccagtcatgccaggattttggaggaaagcacccaggcagagagtgcagaaagggcaaacgctccctggaaagattcttagtcaagagtccttcactcccagtcctaccacaaactgggtcaccttgaacaagtcacgtaacttctgaggctcagctgccacatctacaaaatgggaataaagacatcttacctgccacattgtgagaggtttcaaccaaagggctgttaaggtctgggatcctccccaaatctcaccatagacacctgatactcatcacttggcacccgtcttggaagaggggaacctgcacagagaaccctgggtcatgcttttgatttttaatttcatgctgcactagaaatagcttcttttgttcctggttgacccaagagcctcttcctgccacctggggcctattctagttaacagctgcttatcccctcaggtacaaaagccaacraggaaaggacatcaggaaacattgttctgggaataaccagacacctatctgccaccatctccccccatcccgtgaccacacacgggagactggaggactcagcctgtcctgtagtcagataatgtacatggtttatttaaagagtcaaaaggggccgggcgcagtggctaacgcctgtaatcctagcactctgggaggctggggtgggtggatcacctgagctcaagagtttcagaccaatctggccaacatggtgaaaccctgtctctaccaaaaatacaaaaattagccgggtgtggtggtggacgcctgtaatcccagctacttgggaggctgaggcaggagaattgcttgaacctgggaagtggaggttgcagtgagctgagatcgtgccactgcactccagcctgggcaacaacaacgaaaactccgtctcaaaaaaaaaaaaaaaaaaaaaaagagtcaaaaggatcttggtccctgggttgggccactgat

SEQ ID NO: 161 - DNA, 1001 bp, Homo Sapiens
  allele 501: 12-335-417 : polymorphic base G or C
  misc_binding 481..500: 12-335-417.mis1, potential
  misc_binding 502..521: 12-335-417.mis2, potential complement
  primer_bind 85..102: upstream amplification primer
  primer_bind 534..552: downstream amplification primer, complement
  misc_binding 489..513: 12-335-417 potential probe
agcctttgctgcttttgttcctgcaatttggaacactgtccccatcccagcctctcacctctacccctacctccttcactacctataccttcctatccatccttcaagaccccaaaaaccatccctgattccttcagaaaggcagtttattgcctatcttatcagactgaaagcagtggctgtgtcttatttatggttaattccctagaagctggactgatacattccatttaactaaaattcgtatcaggtgcttcggactgcagacaagcctatcacaacccagaaggaagaaacagggaaggcacctgggggctgccaagcaatgaggtggggggtaggaatcatgaatccgcatatttttaaaaactgccccagatcctgatgtaaacggtacaagagagtctgagaaacacagggctcccctcaaacagtcctgacttcagcattcctggaaaaatgaaaatcctttccttttgcctctaatgctttccctgctgstatcccaggttaaaaaaaaatagataaaatcagggggatttttctgggacttggctgggctgggaaacaagcctgggttctaatacaggctcagcccctgacgtactatgggcccctgcccctccttggggcctccattaccacggccacccccacccttatcaattgtgtgcccctgaggtagtgactgtcccgctctgagcattagtttccccatcttccactagtcgtcgtcagctctgacgctctatgagctatgcatacccgtagctccccgccgaccccgatggtcccctcccctccttcccaaggtccatccgccagggtgcagccgacgcactcctaatgctaaggccgccctctcatcgaccgccccttcctggcctcgactcagcgccaaaggtatgggtctctgccccgcctgctctttaagcctagccggggcggtcagcgcaagcgcactgggtcgcatcgaggccccgccccctgagcctgggtag

SEQ ID NO: 162 - DNA, 1001 bp, Homo Sapiens
  allele 501: 12-337-189 : polymorphic base A or G
  misc_binding 481..500: 12-337-189.mis1, potential
  misc_binding 502..521: 12-337-189.mis2, potential complement
  primer_bind 313..331: upstream amplification primer
  primer_bind 792..812: downstream amplification primer, complement
  misc_binding 489..513: 12-337-189 potential probe
gggcaactagtgtctagtgagggggttgggctggcgcgcactgatcccagactttccggatcttctgcctttagatcgggccggtgtcggggcatgtaggccagtgagactggagccagttagagctacaacggggagcgattagggccaaactttgtccagggtggaagcgagcgggcccgtgaagtggggccagcctgggcagccgaccgtgtcgttgcctcggggcctttccaggcactggcctaagtcctggcgataaagtgcgaccgatttccttgtgggcgttttgaggctttcggtgatctgacccgtctgtcattcattcttcattcattcatgtgatgaatgaatacagtactaagcgcggctaattactaggtagagaagtgatcaagacaaacactgttcctacggtacagggaaaagtgatgggctgtagaatgtagaagcccggggcggagaacagggacagcttccggaacgaaatcgcgagcccaratcaggagtggtggcgagagttccaaagagaagacagcacgtgccaagtcctggaagggggacagaggccaacatatcctggtcactgaagacacctgactctgaatctgtttcacgcccagggaagagatgacagtggccggggctaggctacaaactctggaaatggagataaataaaggaattcaaagtactatatacttaggcagcaaaatccataggatttggggagagtgagatgtaggaaacaagtactcaaggcttgggtacctgggtggggttcatcagaggagaagcagatttgtgggagacaacaacaaattctattctggttgtatggagactcgcaggaaaaaattggatattctagtttgaaggtaggaaagtattgctgtgaagatgtagatttgaatgtcatcagcaaaacataaataaagccaagggagggttgaggctgtagaatgagaaaaacaaagggcccacttagcaccttcatctga

SEQ ID NO: 163 - DNA, 881 bp, Homo Sapiens
  allele 381: 12-340-130 : polymorphic base A or G
  misc_binding 361..380: 12-340-130.mis1, potential
  misc_binding 382..401: 12-340-130.mis2, potential complement
  primer_bind 252..272: upstream amplification primer
  primer_bind 681..701: downstream amplification primer, complement
  misc_binding 369..393: 12-340-130 potential probe
  misc_feature 205,247,340,499,507: n=a, g, c or t
aaaaattagccacgtgtgatggcatgaacctgtagtcccagctactcgggagactgaggcaggaggatcactagagcccaggggttcaaggctgcagtgagctaggatcgtaccactgcactccagcctgtgacacagtgcaactctatctctaaaatcatcccaacaatttttaaaagctgtaattaaaaaaaattctgttaanacaaattctaggttaatataaacagaaaaaaataaatgttangaaaggaatactcccgaatcttaacagtggttgaattttggtgacaagtcccaagacagtttttcacattttccttgacaaacaccttttccnttttaaaatgagaaaaattaggacctttgttttccaaaaargtccaattttcacttaaagcatttaaaaattatctatatgctgagaatatgactaagcccatatgtttaaagacattccctatatacgtatgtattttttattattgtttaaatcaangctaggangctaccccagaacaaaaagaaaaattcttccttagccccttctagctataggccaatacttaggcagcatgtccaagacacctcaagccaaatgaagaaggaagattccatagcattttttaaattaaaaagccagcaggcaaatctttgagactagacagttcagcttgagggtctgagaaagcctctgctcatctcaaaccagcaacaaatctttagaaagtaattcacatgccatgagattgctcgtggcatgaatgtgacactataattcaacatcctgaattaagagagatgtgttattttagcttaaagcagcagattaaaaataaaaatcctaaactactacaccacagattgtcaattctagagaa

SEQ ID NO: 164 - DNA, 961 bp, Homo Sapiens
  allele 461: 12-340-210 : polymorphic base C or T
  misc_binding 442..460: 12-340-210.mis1
  misc_binding 462..481: 12-340-210.mis2, potential complement
  primer_bind 252..272: upstream amplification primer
  primer_bind 681..701: downstream amplification primer, complement
  misc_binding 449..473: 12-340-210 potential probe
  misc_feature 205,247,340,499,507: n=a, g, c or t
aaaaattagccacgtgtgatggcatgaacctgtagtcccagctactcgggagactgaggcaggaggatcactagagcccaggggttcaaggctgcagtgagctaggatcgtaccactgcactccagcctgtgacacagtgcaactctatctctaaaatcatcccaacaatttttaaaagctgtaattaaaaaaaattctgttaanacaaattctaggttaatataaacagaaaaaaataaatgttangaaaggaatactcccgaatcttaacagtggttgaattttggtgacaagtcccaagacagtttttcacattttccttgacaaacaccttttccnttttaaaatgagaaaaattaggacctttgttttccaaaaaagtccaattttcacttaaagcatttaaaaattatctatatgctgagaatatgactaagcccatatgtttaaagacattccytatatacgtatgtattttttattattgtttaaatcaangctaggangctaccccagaacaaaaagaaaaattcttccttagccccttctagctataggccaatacttaggcagcatgtccaagacacctcaagccaaatgaagaaggaagattccatagcattttttaaattaaaaagccagcaggcaaatctttgagactagacagttcagcttgagggtctgagaaagcctctgctcatctcaaaccagcaacaaatctttagaaagtaattcacatgccatgagattgctcgtggcatgaatgtgacactataattcaacatcctgaattaagagagatgtgttattttagcttaaagcagcagattaaaaataaaaatcctaaactactacaccacagattgtcaattctagagaagcactgggctcagctttctgcacatctgtatttattgttaactgcacttgcaggagggaaaagaaagaagtctcatgact

SEQ ID NO: 165 - DNA, 973 bp, Homo Sapiens
  allele 473: 12-340-222 : polymorphic base G or T
  misc_binding 453..472: 12-340-222.mis1, potential
  misc_binding 474..493: 12-340-222.mis2, potential complement
  primer_bind 252..272: upstream amplification primer
  primer_bind 681..701: downstream amplification primer, complement
  misc_binding 461..485: 12-340-222 potential probe
  misc_feature 205,247,340,499,507: n=a, g, c or t
aaaaattagccacgtgtgatggcatgaacctgtagtcccagctactcgggagactgaggcaggaggatcactagagcccaggggttcaaggctgcagtgagctaggatcgtaccactgcactccagcctgtgacacagtgcaactctatctctaaaatcatcccaacaatttttaaaagctgtaattaaaaaaaattctgttaanacaaattctaggttaatataaacagaaaaaaataaatgttangaaaggaatactcccgaatcttaacagtggttgaattttggtgacaagtcccaagacagtttttcacattttccttgacaaacaccttttccnttttaaaatgagaaaaattaggacctttgttttccaaaaaagtccaattttcacttaaagcatttaaaaattatctatatgctgagaatatgactaagcccatatgtttaaagacattccctatatacgtatktattttttattattgtttaaatcaangctaggangctaccccagaacaaaaagaaaaattcttccttagccccttctagctataggccaatacttaggcagcatgtccaagacacctcaagccaaatgaagaaggaagattccatagcattttttaaattaaaaagccagcaggcaaatctttgagactagacagttcagcttgagggtctgagaaagcctctgctcatctcaaaccagcaacaaatctttagaaagtaattcacatgccatgagattgctcgtggcatgaatgtgacactataattcaacatcctgaattaagagagatgtgttattttagcttaaagcagcagattaaaaataaaaatcctaaactactacaccacagattgtcaattctagagaagcactgggctcagctttctgcacatctgtatttattgttaactgcacttgcaggagggaaaagaaagaagtctcatgacttgaggcaacaat

SEQ ID NO: 166 - DNA, 975 bp, Homo Sapiens
  allele 491: 12-340-240 : polymorphic base C or T
  misc_binding 471..490: 12-340-240.mis1, potential
  misc_binding 492..511: 12-340-240.mis2, potential complement
  primer_bind 252..272: upstream amplification primer
  primer_bind 681..701: downstream amplification primer, complement
  misc_binding 479..503: 12-340-240 potential probe
  misc_feature 205,247,340,499,507: n=a, g, c or t
aaaaattagccacgtgtgatggcatgaacctgtagtcccagctactcgggagactgaggcaggaggatcactagagcccaggggttcaaggctgcagtgagctaggatcgtaccactgcactccagcctgtgacacagtgcaactctatctctaaaatcatcccaacaatttttaaaagctgtaattaaaaaaaattctgttaanacaaattctaggttaatataaacagaaaaaaataaatgttangaaaggaatactcccgaatcttaacagtggttgaattttggtgacaagtcccaagacagtttttcacattttccttgacaaacaccttttccnttttaaaatgagaaaaattaggacctttgttttccaaaaaagtccaattttcacttaaagcatttaaaaattatctatatgctgagaatatgactaagcccatatgtttaaagacattccctatatacgtatgtattttttattattgttyaaatcaangctaggangctaccccagaacaaaaagaaaaattcttccttagccccttctagctataggccaatacttaggcagcatgtccaagacacctcaagccaaatgaagaaggaagattccatagcattttttaaattaaaaagccagcaggcaaatctttgagactagacagttcagcttgagggtctgagaaagcctctgctcatctcaaaccagcaacaaatctttagaaagtaattcacatgccatgagattgctcgtggcatgaatgtgacactataattcaacatcctgaattaagagagatgtgttattttagcttaaagcagcagattaaaaataaaaatcctaaactactacaccacagattgtcaattctagagaagcactgggctcagctttctgcacatctgtatttattgttaactgcacttgcaggagggaaaagaaagaagtctcatgacttgaggcaacaatga

SEQ ID NO: 167 - DNA, 1001 bp, Homo Sapiens
  allele 501: 12-341-99 : polymorphic base A or G
  misc_binding 481..500: 12-341-99.mis1, potential
  misc_binding 502..520: 12-341-99.mis2, complement
  primer_bind 403..422: upstream amplification primer
  primer_bind 927..947: downstream amplification primer, complement
  misc_binding 489..513: 12-341-99 potential probe
  misc_feature 133,141,738,898: n=a, g, c or t
ttgttttccaaaaaagtccaattttcacttaaagcatttaaaaattatctatatgctgagaatatgactaagcccatatgtttaaagacattccctatatacgtatgtattttttattattgtttaaatcaangctaggangctaccccagaacaaaaagaaaaattcttccttagccccttctagctataggccaatacttaggcagcatgtccaagacacctcaagccaaatgaagaaggaagattccatagcattttttaaattaaaaagccagcaggcaaatctttgagactagacagttcagcttgagggtctgagaaagcctctgctcatctcaaaccagcaacaaatctttagaaagtaattcacatgccatgagattgctcgtggcatgaatgtgacactataattcaacatcctgaattaagagagatgtgttattttagcttaaagcagcagattaaaaataaaaatcctaaactactacaccacagattrtcaattctagagaagcactgggctcagctttctgcacatctgtatttattgttaactgcacttgcaggagggaaaagaaagaagtctcatgacttgaggcaacaatgaaaactgccctgaacatatgcctgctttgctttgtataatagagacctaaggtcatcctctagaaaaggtgaagtaattattatacagtatataaccattttatagcctgttttcatcatgaattttccncatattactataactttaacattatattaacaacttcataaaattcaacaaaatagatagaataaccattatcttctcctggtagatagtcattacaaataatgttacacctaacggtcttggtatacacaagctttatctcattttgacttacgtcttncatcagagtcacagaaatggaaacaacagggcaaaatgagtagtaatgtttaaagctctgaagtatactacaccaattcttctcaaaagagatcacattcatc

SEQ ID NO: 168 - DNA, 1001 bp, Homo Sapiens
  allele 501: 12-342-32 : polymorphic base T or C
  misc_binding 481..500: 12-342-32.mis1, potential
  misc_binding 502..521: 12-342-32.mis2, potential complement
  primer_bind 513..532: upstream amplification primer, complement
  primer_bind 81..101: downstream amplification primer
  misc_binding 489..513: 12-342-32 potential probe
tgtacttcaaatgggtgaaatgtatggtatatgaaccatatcttaataaagctgattaaaaaaaactatggaaaaatatcacttttctcataactgcttagtaaatacttaaaatacactgtttgtggaagggggcttctgggtactggtaatgttctatttcctaatttgggtggtagtgcaaaagtgaatgtattttgtggtaattattggtgtacttttctgtatgaaggttatacttcagtaacaaagtctataaaaatacacacataaacacagtatgttggtgatggtatgggtaaacagacgctcatactttgttcctggggatataaactgacaaaacttcttaggtaggtaaacttcagatttataaacaataaaaaacatacgttcttgttccaaaggtatatactcacatgtatacaaaaatatgtaaaagatctttactgcaaccttgtctgtaagagaaatggtgtggaaaaattataaatgccagtyaactggggcctgggtaaataaattatggcacaatcacaccaggaaacactaaccatttaatttttttttgagagctcatcacccaggctagagtgcagtggtatgatcttggctcacggcaacctctgcctcccggcttcaagcaattctcctgcctcagcctcctgagtagctgggattacaagtgcctgccaccgtgcccatctaattttggtatttttagtagagacagggtttcaccatcttggacaggttggtctcgaactcctgacctcacgatccacctgccttggcctcccaaagtgctgggattacaggcgtgagccactgcgcccggcctaaaattgttttaattaaaaaaaaaaaaagaagaagaaagaaggtacagaatagtgtagccgtgtatatggtatatcactctatgtgcggagaaaataaactaaggtggaggtggtggggaatatttacacacacacacacacacacacacaaaaaaaaca

SEQ ID NO: 169 - DNA, 1001 bp, Homo Sapiens
  allele 501: 12-344-349 : polymorphic base G or T
  misc_binding 481..500: 12-344-349.mis1, potential
  misc_binding 502..520: 12-344-349.mis2, complement
  primer_bind 154..173: upstream amplification primer
  primer_bind 685..705: downstream amplification primer, complement
  misc_binding 489..513: 12-344-349 potential probe
cttaggatatatctaggatttgttttttttgttttttgtgttttttggctatttaagtagaccacaaatgaacaacttaatatatatgtgtatccttttcatgtttgtattaaactagttcctcaagatacattttcaaaagtagaactactagaatctaaagtataggcatcttttttttgttcatttgttttggttttttaaatgaggtcttactctgtcactcaggggcacaatcacagctcactgtagtctcgaactcctaggctcaagcaattttccctcctcaccctcccgagtggctaggactgcatgcgcgtgtaccacgcctggctaaaagttaaaagtataagcatctcaattgctcttgttataaatttccattgaaagttctactgcagcaaacaaaaataccatttttatcagactcattaactgagcatttctttttttgttgctgttatctgtgttgggcaaatggctcttaatgtctgatctatkactaattcttataaagaaactactacttccctgtgagcaggaacaggaaagtagcataaaaacgaaacttaattttcatgagcccaaaaccaaaagatgatgaaactgagtatgaaccatggacaaagtgctttatttggcacttgcttctattttttaaaattgtttccattcactcctaagctgctaggaatgctaaaatgctaggtctccttctcagatcccaatgggcagccctgccaagctagcttgactagatgggttgtctcataatcctgagacaacgcagacgctctgcatcccttatcaccacctttcaacctactggggctctgtgattgatttatttaacgacttcagagcagggtgaaacactgctctgcatgtctcactatatatctcactatttctagatcctccatttttaaaaggaattgggattcactcattcatcaagtattgttcagcatctactctagagcagatacagtggtgaggga

SEQ ID NO: 170 - DNA, 1001 bp, Homo Sapiens
  allele 501: 12-345-453 : polymorphic base G or C
  misc_binding 481..500: 12-345-453.mis1, potential
  misc_binding 502..521: 12-345-453.mis2, potential complement
  primer_bind 53..70: upstream amplification primer
  primer_bind 558..578: downstream amplification primer, complement
  misc_binding 489..513: 12-345-453 potential probe
cagatcccaatgggcagccctgccaagctagcttgactagatgggttgtctcataatcctgagacaacgcagacgctctgcatcccttatcaccacctttcaacctactggggctctgtgattgatttatttaacgacttcagagcagggtgaaacactgctctgcatgtctcactatatatctcactatttctagatcctccatttttaaaaggaattgggattcactcattcatcaagtattgttcagcatctactctagagcagatacagtggtgagggaaaaaaagtctcagccttcatggaacctataaatctagtgggaagaagagagactaaacaagtgcaccaacaaataattacaatatgctacttgctatgagggtacatagagaacatgaaagaccaagttagaatacacagctgagacattaaaaatgaatataaatcctcttaataaccactactgcatgcacaaatgaggccttatacagtatgtcstattggggtaaaaaaaaaatcttttaaattaaaaaaacgcaaagttggtaggagggcattcaccaaacattaactgaagtcatctctggcttttaacaccagagtaaagtgcattcacttttttattttaaattaaataccgaagctgggtgcggtggctcatgcctgtaatcccagcacttgggaggctgaggtgggcagatcacttgaggtcaggagttcgagaccagcctggtcaacatggtgaaaccccatctctactaaaaaaaaaaatacaaaaattagccgggtatggtggtgggcgcctgtaatcccagctacttgagagggtgaggcaggaaaatcacttgagctcaggaggcggaggttgcagtgagccaagatcatgccactgcactccagcctgggcaacagagcgagagactgtctcaaaaaaaaaaaaattgaatacctaaaaagaattatttgtaacgtgtaagttataaaaaataataatagaa

SEQ ID NO: 171 - DNA, 1001 bp, Homo Sapiens
  allele 501: 12-346-204 : polymorphic base G or A
  misc_binding 481..500: 12-346-204.mis1, potential
  misc_binding 502..521: 12-346-204.mis2, potential complement
  primer_bind 684..704: upstream amplification primer, complement
  primer_bind 248..267: downstream amplification primer
  misc_binding 489..513: 12-346-204 potential probe
  misc_feature 664,706: n=a, g, c or t
aaagcaggctgctagctcatgcagtgggcagccccctccctgcctggagtgaaatgagatccccatcacagagattacaaggggaagtggctagagggcctcaggcagaatttttttttttttttttttttgagacacagtctcactctgttgcccaggctggagtgcagtggcgtgatctcagctcactgcaacctctgcctcctgggttcaagcaattctggtggccgctccacagacattacaaaacacgaggcaacactccaccctgaggtctgaagacccaaacacaagcattagtgccccatgagcaatcgaaagagaccttaagaaagtattttaaaaatgattaaaaacagaatatgcagcagaaaaaagatattaacatcatggctaagcagtttccgaattgagccagacagaacatctagaaatgcaaaatatatttgcttgaaattaaaaactcaaatgataaagcagaagacaggtcgctgagggaartccccagagtgcagtgaagagaagagggccccatggcaccaggccgatggctgggtggcacttttaggtcccagagcactttccttctcatgctggtaggcagggtgccgactagccggggggccaataggggaaagagtattatccttcttttgcaagaaanacagaggctcagagattcagtgattcattcaagctcttccancaagccttccaatgtcctgttcagagctctctcaaggggactgtgagagacacaagctaaaggagagtgcttgggctcaaaaaaccaaagccacctttttttgtatgagacagtgtctttgctctgtcacccaggccggatgtgcagtggcttgatcttagttcactgcaacctctacctcccgggttcaagtgattctcccacctcagcctcctgagtagcagggattacaggtgccccaccaacatgcctggctaatttttgtatttttagtagagacggggtttcaccatgt

SEQ ID NO: 172 - DNA, 1001 bp, Homo Sapiens
  allele 501: 10-364-55 : polymorphic base G or T
  misc_binding 481..500: 10-364-55.mis1, potential
  misc_binding 502..521: 10-364-55.mis2, potential complement
  primer_bind 447..464: upstream amplification primer
  primer_bind 849..867: downstream amplification primer, complement
  misc_binding 489..513: 10-364-55 potential probe
  misc_feature 180: n=a, g, c or t
tactcacaagtaattttacattttttttgtacggagtcttcaaaatctggtgtatattttactctcacagcatgtgcatgttttcattaggacaagccatatttcaagtactcagtggccactgtgtgcctggtagcttctggactaaacaagcatgagtctggaggataattattaatncctgcagagatgagggagggaggagcaaggtattggggctccagagatgcctgggcaaagtgggtactaaagtttgaccaaagtctttggagttaatttgggacatgttgcaaacagtgaaagcagaccatggcagactttgaacacctgaattgatttggtaagttacagggagccttgggagcaggggttgagcaggagacagaactgcattctcgagcaggagccaaagaattgatactaatgcaaaatctttaatcacaaagttcccttgtagtgtcttgacaccacagatacattttctgttgagttgtcttagakaactaatttgaggtatgatttcattccacttacttgtatgtaatcaaattcttcttttacacgatgactcttaggtgaccaatttatgacgtttggttgtctgttttagtaccttaacaagaaatatccgacataggagaggagaaaaggttgtcatcaatgtaccaagtaagtctactgagaggtggtggggtgggagagagacatgttgtattgttgtttaatcctggattctaaaccatttttatttttgtatttttataatacagtatttaaggacaagaatacaccatctccatttatagaaacatttactgaggatgatgaagcttcaagggcttctaagccggatcatatttacatggatgccatgggatttggaatgggcaattgctgtctccaggtatagtttcaaatatacagagaggcaaagtgttccatccatttctgttttttaacttctttatatatgcatgtttcctgttccaaaaatcacattt

SEQ ID NO: 173 - DNA, 1001 bp, Homo Sapiens
  allele 501: 10-364-108 : polymorphic base C or T
  misc_binding 481..500: 10-364-108.mis1, potential
  misc_binding 502..521: 10-364-108.mis2, potential complement
  primer_bind 394..411: upstream amplification primer
  primer_bind 796..814: downstream amplification primer, complement
  misc_binding 489..513: 10-364-108 potential probe
  misc_feature 127: n=a, g, c or t
atattttactctcacagcatgtgcatgttttcattaggacaagccatatttcaagtactcagtggccactgtgtgcctggtagcttctggactaaacaagcatgagtctggaggataattattaatncctgcagagatgagggagggaggagcaaggtattggggctccagagatgcctgggcaaagtgggtactaaagtttgaccaaagtctttggagttaatttgggacatgttgcaaacagtgaaagcagaccatggcagactttgaacacctgaattgatttggtaagttacagggagccttgggagcaggggttgagcaggagacagaactgcattctcgagcaggagccaaagaattgatactaatgcaaaatctttaatcacaaagttcccttgtagtgtcttgacaccacagatacattttctgttgagttgtcttagagaactaatttgaggtatgatttcattccacttacttgtatgtaatcaaattctycttttacacgatgactcttaggtgaccaatttatgacgtttggttgtctgttttagtaccttaacaagaaatatccgacataggagaggagaaaaggttgtcatcaatgtaccaagtaagtctactgagaggtggtggggtgggagagagacatgttgtattgttgtttaatcctggattctaaaccatttttatttttgtatttttataatacagtatttaaggacaagaatacaccatctccatttatagaaacatttactgaggatgatgaagcttcaagggcttctaagccggatcatatttacatggatgccatgggatttggaatgggcaattgctgtctccaggtatagtttcaaatatacagagaggcaaagtgttccatccatttctgttttttaacttctttatatatgcatgtttcctgttccaaaaatcacattttaatgaggttgaaatggtagctggtatgcctttctgaaaaacaatgaagttat

SEQ ID NO: 174 - DNA, 1001 bp, Homo Sapiens
  allele 501: 10-364-267 : polymorphic base A or T
  misc_binding 481..500: 10-364-267.mis1, potential
  misc_binding 502..521: 10-364-267.mis2, potential complement
  primer_bind 235..252: upstream amplification primer
  primer_bind 637..655: downstream amplification primer, complement
  misc_binding 489..513: 10-364-267 potential probe
ttggggctccagagatgcctgggcaaagtgggtactaaagtttgaccaaagtctttggagttaatttgggacatgttgcaaacagtgaaagcagaccatggcagactttgaacacctgaattgatttggtaagttacagggagccttgggagcaggggttgagcaggagacagaactgcattctcgagcaggagccaaagaattgatactaatgcaaaatctttaatcacaaagttcccttgtagtgtcttgacaccacagatacattttctgttgagttgtcttagagaactaatttgaggtatgatttcattccacttacttgtatgtaatcaaattcttcttttacacgatgactcttaggtgaccaatttatgacgtttggttgtctgttttagtaccttaacaagaaatatccgacataggagaggagaaaaggttgtcatcaatgtaccaagtaagtctactgagaggtggtggggtgggagagagacatgttgwattgttgtttaatcctggattctaaaccatttttatttttgtatttttataatacagtatttaaggacaagaatacaccatctccatttatagaaacatttactgaggatgatgaagcttcaagggcttctaagccggatcatatttacatggatgccatgggatttggaatgggcaattgctgtctccaggtatagtttcaaatatacagagaggcaaagtgttccatccatttctgttttttaacttctttatatatgcatgtttcctgttccaaaaatcacattttaatgaggttgaaatggtagctggtatgcctttctgaaaaacaatgaagttatattagtaaattcattggaagctgtctatgactaatagttctacagactctgttgttcaccacaaaggtatatacggtatatatacctttataactgtaatttcagttaacttaaaatgcaatatattctgtcattgtttcccttctctttttatatgcc

SEQ ID NO: 175 - DNA, 997 bp, Homo Sapiens
  allele 497: 10-367-20 : polymorphic base G or T
  misc_binding 477..496: 10-367-20.mis1, potential
  misc_binding 498..517: 10-367-20.mis2, potential complement
  primer_bind 478..495: upstream amplification primer
  primer_bind 889..908: downstream amplification primer, complement
  misc_binding 485..509: 10-367-20 potential probe
agcgttgttaacttgcccctctctgcccagcaccttccttctctgacttcactgcttggggagcatgctaatgattccttggtgttaataactttgcaattcttaaacaggtgacattccaagcctgcagtatatctgaggccagatacctttatgatcagttggctactatctgtccaattgttgtaagtagaaattacctcttattttaaatactacttcgtatgaaataagatagcatgtgcagaatttactgacagtgtgctatttaagtccagttaagacctcagtcagagatggactaatataaatagtatgtaggtttaggtataatgaactgagagtctacactgtagaagtttactcttgctagtacaacattgatttgttaaatgtgaagtttgaatgtggccattttccctcccccatacttcatgtcctcacattagagagaggatgatttaagtgaatcaaacccaaggaactggattcttcckggtatatttcactgtaagataggcacaggtacatgtgctctgtatgggttgcataaacatgctttttgatcagaaatataactgcatggagctttttttagcatgtaagtgacactttgaatttgcaggagctgacttttgtttgtttttagatggctttgagtgctgcatctcccttttaccgaggctatgtgtcagacattgattgtcgctggggagtgatttctgcatctgtagatgatagaactcgggaggagcgaggactggaggtgggaattgtttttccttaatagcccttttaagtcaagcaggtaaaatggatcttttgtaactacttgcaatttcaggatgtctccctgcaatttttatctgaaatggggaaaaagatttggtctaggtggggagttaatttttatcgtatgttgatgtctgtatttgttttagcttcatttaaaattagtagtccgatttttctatattttggaagtgctgatggctgt

SEQ ID NO: 176 - DNA, 1001 bp, Homo Sapiens
  allele 501: 10-351-389 : polymorphic base A or G
  misc_binding 481..500: 10-351-389.mis1, potential
  misc_binding 502..521: 10-351-389.mis2, potential complement
  primer_bind 113..132: upstream amplification primer
  primer_bind 518..537: downstream amplification primer, complement
  misc_binding 489..513: 10-351-389 potential probe
gtgatctgcttttaaaagataaaagtatatttaaatcataccagaaaaaaagggtatttaaattgccttcagattttaaaaaacataattttccttaataatactttttagggctcactaactttttttctgtatcttatgttgaggtttttatataattatcatatataaaaatatattccactcattttatatagcatattcatttatatatatttttaatctttagccattgaagaacaataactataggatcagtaaatcccgatatgactcaatagacagctatttatctaagtgtggtgagaaatataatgacatcgacttgacgatagataaagagatctacgaacagctgttgcaggaaggtgggtttctactccatctttctgggtttgaatgtacgcctttagttcttcaaagctcttttacacttttttgctgactcctggtctggtttctatttttagtgcaaagtctttaacttctctcatgaggctrcttgttcctaaagtttcaggttccaaatacttgtgagattttcttgatttttagcaaaaggagcttactttggaggtctgtgtctaggtccacaccagtgccccagcaggcattgtgtaagtagtgaataaaacgctgacactcccgcagtgtccgcaggataaaatactgggtgaggtgaggatactaatcaaaccagctatttcaagcttctagacaccctttcttcaaacttcctgagctatcctgtcgtctttctggactaagaggaagtggtatctctcgctttgcagtgagttcccatgtgatctctttttgcaggcattgatcatctcctggcccagcatgttgctcatctctttattagagacccactgacactgtttgaagagaaaatacacctggatgatgctaatgagtctgaccattttgaggtatcttctcagttttatttttatttatttatgtattgacttctgagagtctggaatcctctgttt

SEQ ID NO: 177 - DNA, 1001 bp, Homo Sapiens
  allele 501: 10-353-102 : polymorphic base A or T
  misc_binding 481..500: 10-353-102.mis1, potential
  misc_binding 502..521: 10-353-102.mis2, potential complement
  primer_bind 400..417: upstream amplification primer
  primer_bind 800..819: downstream amplification primer, complement
  misc_binding 489..513: 10-353-102 potential probe
ctttcccccaccaaactcacaaaaggagatataaatccttccagtcttgccatcgggtcccaagatggtcaggacggagaaagaactctctctcagtgtattgagaaacagctacccttcttaggctcttgggtcatcgaagcagcagcattcccaggagaggaggaagaaaggaaacaactgtcatgtgacagggttctcagatgaaagtgtccagtgtcacctggaaaggcaggctggctcctaaaattctcagggatgaaggtgggggccccgtggctcttcagatgctgctctgtagctgggagatagggagtaggagctgggtgagattaagcttgcagtgatagggcctcatagcttttgttaaacacttggctgttttgttttcctaaaagagcacactcgaagaaaatcttcaattgtacctttttgtctttgtcaattgaaatttggtatggacagtgagcagtcttcttccttaattaaataccagatcawcttaatattttcctggatgtgtgaaaagttggttttcttctctgcttttgtatcacagaatattcagtccacaaattggcagacaatgagatttaagccccctcctccaaactcagacattggatggagagtagaatttcgacccatggaggtaagacacatgcatcagcaagaactgactcaaaagtactctttcgccagctgttcatcacccttctgatgctgctatgagaaggctcttatatataaaataaaaattaagtatgtgcatggtagcaagtcagtccaagttaaggagggttgatttctgagaatagatgtgggcaaagggcttccagacccagatggggaattaggagatggcttgggaatgacatgatctgaggaagggcctgggtcagggaagagcatgtttgtgtagttggttcataacttctctgggcttctgcttgtctaggtgcaattaacagactttgagaactctgcctatgtggtgtttg

SEQ ID NO: 178 - DNA, 1001 bp, Homo Sapiens
  allele 501: 10-354-72 : polymorphic base A or G
  misc_binding 482..500: 10-354-72.mis1
  misc_binding 502..521: 10-354-72.mis2, potential complement
  primer_bind 430..447: upstream amplification primer
  primer_bind 830..849: downstream amplification primer, complement
  misc_binding 489..513: 10-354-72 potential probe
tagcttttgttaaacacttggctgttttgttttcctaaaagagcacactcgaagaaaatcttcaattgtacctttttgtctttgtcaattgaaatttggtatggacagtgagcagtcttcttccttaattaaataccagatcatcttaatattttcctggatgtgtgaaaagttggttttcttctctgcttttgtatcacagaatattcagtccacaaattggcagacaatgagatttaagccccctcctccaaactcagacattggatggagagtagaatttcgacccatggaggtaagacacatgcatcagcaagaactgactcaaaagtactctttcgccagctgttcatcacccttctgatgctgctatgagaaggctcttatatataaaataaaaattaagtatgtgcatggtagcaagtcagtccaagttaaggagggttgatttctgagaatagatgtgggcaaagggcttccagacccagatggggaattagragatggcttgggaatgacatgatctgaggaagggcctgggtcagggaagagcatgtttgtgtagttggttcataacttctctgggcttctgcttgtctaggtgcaattaacagactttgagaactctgcctatgtggtgtttgtggtactgctcaccagagtgatcctttcctacaaattggattttctcattccactgtcaaaggtaaggatatgtttctttatggtgatgggtatagatctatctgtagatatatttatttatatatgctatttatttcccacctaatttcatttgaaattgtttaccctttgcaataaaatgtttctccatcagccctattctttattttcttttaaacctaagcttaatttctagacgctttccattcaagatgattgatggctagaagtagtcctacacattgatttcatccaccacaaaatcccaggttgattacaatgttaaattaggatggggagggaaagtgtaactgctg

SEQ ID NO: 179 - DNA, 1001 bp, Homo Sapiens
  allele 501: 10-354-320 : polymorphic base A or G
  misc_binding 481..500: 10-354-320.mis1, potential
  misc_binding 502..521: 10-354-320.mis2, potential complement
  primer_bind 182..199: upstream amplification primer
  primer_bind 582..601: downstream amplification primer, complement
  misc_binding 489..513: 10-354-320 potential probe
ctccaaactcagacattggatggagagtagaatttcgacccatggaggtaagacacatgcatcagcaagaactgactcaaaagtactctttcgccagctgttcatcacccttctgatgctgctatgagaaggctcttatatataaaataaaaattaagtatgtgcatggtagcaagtcagtccaagttaaggagggttgatttctgagaatagatgtgggcaaagggcttccagacccagatggggaattaggagatggcttgggaatgacatgatctgaggaagggcctgggtcagggaagagcatgtttgtgtagttggttcataacttctctgggcttctgcttgtctaggtgcaattaacagactttgagaactctgcctatgtggtgtttgtggtactgctcaccagagtgatcctttcctacaaattggattttctcattccactgtcaaaggtaaggatatgtttctttatggtgatgggtatagatctatctrtagatatatttatttatatatgctatttatttcccacctaatttcatttgaaattgtttaccctttgcaataaaatgtttctccatcagccctattctttattttcttttaaacctaagcttaatttctagacgctttccattcaagatgattgatggctagaagtagtcctacacattgatttcatccaccacaaaatcccaggttgattacaatgttaaattaggatggggagggaaagtgtaactgctggaatgccggtaaaagtctcctcagtagaactgaacttgagatatttctgaagaattcggatgggattgaactctcagaaaaacaaattggagttaatctgccccccaaaagaccaaaaaacaagctttctgggaggagtttgccagcaaaacaactccaggtgatgagggagcagagctgtgggttgtggagcagtagctgaggaggtgaacgcctttggtttctgggccagggttcctcttggcaga

SEQ ID NO: 180 - DNA, 1001 bp, Homo Sapiens
  allele 501: 10-354-360 : polymorphic base A or G
  misc_binding 481..500: 10-354-360.mis1, potential
  misc_binding 502..521: 10-354-360.mis2, potential complement
  primer_bind 142..159: upstream amplification primer
  primer_bind 542..561: downstream amplification primer, complement
  misc_binding 489..513: 10-354-360 potential probe
catggaggtaagacacatgcatcagcaagaactgactcaaaagtactctttcgccagctgttcatcacccttctgatgctgctatgagaaggctcttatatataaaataaaaattaagtatgtgcatggtagcaagtcagtccaagttaaggagggttgatttctgagaatagatgtgggcaaagggcttccagacccagatggggaattaggagatggcttgggaatgacatgatctgaggaagggcctgggtcagggaagagcatgtttgtgtagttggttcataacttctctgggcttctgcttgtctaggtgcaattaacagactttgagaactctgcctatgtggtgtttgtggtactgctcaccagagtgatcctttcctacaaattggattttctcattccactgtcaaaggtaaggatatgtttctttatggtgatgggtatagatctatctgtagatatatttatttatatatgctatttatttcccacctratttcatttgaaattgtttaccctttgcaataaaatgtttctccatcagccctattctttattttcttttaaacctaagcttaatttctagacgctttccattcaagatgattgatggctagaagtagtcctacacattgatttcatccaccacaaaatcccaggttgattacaatgttaaattaggatggggagggaaagtgtaactgctggaatgccggtaaaagtctcctcagtagaactgaacttgagatatttctgaagaattcggatgggattgaactctcagaaaaacaaattggagttaatctgccccccaaaagaccaaaaaacaagctttctgggaggagtttgccagcaaaacaactccaggtgatgagggagcagagctgtgggttgtggagcagtagctgaggaggtgaacgcctttggtttctgggccagggttcctcttggcagagagtggctgggaaaaactgctaaatagagagggccctgcc

SEQ ID NO: 181 - DNA, 1001 bp, Homo Sapiens
  allele 501: 10-355-87 : polymorphic base A or G
  misc_binding 481..500: 10-355-87.mis1, potential
  misc_binding 502..521: 10-355-87.mis2, potential complement
  primer_bind 415..434: upstream amplification primer
  primer_bind 821..840: downstream amplification primer, complement
  misc_binding 489..513: 10-355-87 potential probe
agtgtggtggtgcaggcctgtaatcccagctgcttgggaggctgaggcacaaagaattgcttgaacccaggagacagaggttggggtgagatgagattgcaccactgcactccaacctgggcaacagagcgagactccatctcaaaaaaacagaagaagaactgggttctagtcctgccttctgccttcgttaccctgggactcctggtgagacactgctatataaagggaaccagccacctgccctcccaacactgtatatctgttgcaaggctcagtcacagaggtgctttgaaatgcagacgttccacatgaatataagttttgggttttaagtttctcttaaaattccctgattggttgaaaaatcacataccaatccatgattgagtgatacagtcctcacataaataaaaagcctgttcctcccactgggaagcatttgagcagaaagtagaatccctaagggaatgagtcctaattgcaaaggtgaggaaggtrctgcaacttgtatgtctgatcaagaatattttgacttagtcgtgattctttttttcccttaggttgatgagaacatgaaggtagcacagaaaagagatgctgtcttgcagggaatgttttatttcaggaaagatatttgcaaaggtattacattatcttagatttctaatgtcagcttatgctgcaacaagctgctaaagctcccctgaccctcttctccggcaggtggcaatgcagtggtggatggttgtggcaaggcccagaacagcacggagctcgctgcagaggagtacaccctcatgagcatagacaccatcatcaatgggaaggtaggagggtggccctgtacagtacgcctcactgtgcacatcccccggcagggagttcataaagtgtcctgcttcttgtaggaaggtgtgtttcctggactgatcccaattctgaactcttaccttgaaaacatggaagtggatgtggacaccagatgtagtattctgaac

SEQ ID NO: 182 - DNA, 1001 bp, Homo Sapiens
  allele 501: 10-358-60 : polymorphic base A or G
  misc_binding 481..500: 10-358-60.mis1, potential
  misc_binding 502..521: 10-358-60.mis2, potential complement
  primer_bind 442..460: upstream amplification primer
  primer_bind 870..889: downstream amplification primer, complement
  misc_binding 489..513: 10-358-60 potential probe
tttctggagtcacaaaggatagccgtagaaccctacctcacccctcaaatggtatactgccaatttcccacttcattcactctacttactgttctttattctctccacctctttgatcaaagatcgctcaaggaccctacagtcctctgaggcagtctcatgacactggcatttgtagtcctagccctctggccaaatgggagggcacatgttcttgtacacatgtgctggctcctgttccttaagagctggcagtgtcagcatatgggtggcatctaacaggtaccatagaaactggatgtatgtgttctcattgcctgcctgcaacctagaattcctgcccaggaggagttcttcaaacgctatgaaagatgttcccaccccctgccatgcagctacactaaaaggacatattgatttctctccagaattgtgtttatgctgaccactaaatatcaacttattaaaaaaaaaacttacgtggttttaatttttttttcrctcccccctcgcccacaggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagccagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattctta

SEQ ID NO: 183 - DNA, 1001 bp, Homo Sapiens
  allele 501: 12-468-63 : polymorphic base C or T
  misc_binding 481..500: 12-468-63.mis1, potential
  misc_binding 502..520: 12-468-63.mis2, complement
  primer_bind 439..458: upstream amplification primer
  primer_bind 946..966: downstream amplification primer, complement
  misc_binding 489..513: 12-468-63 potential probe
  misc_feature 376,386,618: n=a, g, c or t
cagtgcaaagacccagaacccagccttccttcacctgaaacagctgcagcgtgcacacacacttcttgtgcatatatctctggtctatttattttcaaaactaagtataatccaaattgaatgctggaatcagatttttccattctgaatgtgtttaaataacatggccaaggataatttctttctgttttcttgacatttataggtagtataaaatatgtgacttccaaataaacataaaccatcacacttcacgaaaaaagagatctttcgacttttaactgcctgtttcctatcttaattacaagtatttctaaagaaaaccattaagttctagagcttacagtacatggttttaaaattgtataagtgctgnttaagagtanttgattgccttttcttggtttaatattaaaccagggtgttctgccaaagaccgcatagtttctctgatatggttccaaagggatattctttccactgaaacactgtatgtatacyagtaaatgcttcctaatggtagatgataaatatttttgttgcttgtagatagaatttttccatctagtgtaagcttaggattgttttctttttcccagtgacatgtacagtttcacntactccacttaaaaaaaatcgttagctcagataaagtgtgtggcacatgaaatgaattttgccaattcaccaccgaaatccctgctttatatctcttcagtggaacactaaaccaacttctttcccaagtacactgatttgatctttacaaattatatgaatgtattaaattatcacatgtgccctgaaactgtgtacatctattatgtatcattagagagatggaaaaaaaaaaaagaaactgcttagtaaagtagaaaaaatagttttaaagtaattttgtaaggctaatggaagacttactgtataaaacaaaaaggattttaaccacattcaaattattgactgttttggggcttttcaggaatcacttaaaaagcacc

SEQ ID NO: 184 - DNA, 1001 bp, Homo Sapiens
  allele 501: 12-468-388 : polymorphic base C or T
  misc_binding 481..500: 12-468-388.mis1, potential
  misc_binding 502..521: 12-468-388.mis2, potential complement
  primer_bind 113..132: upstream amplification primer
  primer_bind 620..640: downstream amplification primer, complement
  misc_binding 489..513: 12-468-388 potential probe
  misc_feature 50,60,292,676: n=a, g, c or t
ttaagttctagagcttacagtacatggttttaaaattgtataagtgctgnttaagagtanttgattgccttttcttggtttaatattaaaccagggtgttctgccaaagaccgcatagtttctctgatatggttccaaagggatattctttccactgaaacactgtatgtataccagtaaatgcttcctaatggtagatgataaatatttttgttgcttgtagatagaatttttccatctagtgtaagcttaggattgttttctttttcccagtgacatgtacagtttcacntactccacttaaaaaaaatcgttagctcagataaagtgtgtggcacatgaaatgaattttgccaattcaccaccgaaatccctgctttatatctcttcagtggaacactaaaccaacttctttcccaagtacactgatttgatctttacaaattatatgaatgtattaaattatcacatgtgccctgaaactgtgtacatctattatgyatcattagagagatggaaaaaaaaaaaagaaactgcttagtaaagtagaaaaaatagttttaaagtaattttgtaaggctaatggaagacttactgtataaaacaaaaaggattttaaccacattcaaattattgactgttttggggcttttcaggaatcacttaaaaagcaccnaagttcacagccaggcacggtggctcatgcctgtaatcccagcactttgggaggctgaggtgggcagatcacttgaggtcaggagtttgagacaagcctggtcatcatggcaaaatctcatctctactaaaaatacaaaaattagacctggtggcatgtgcctgtaatcccagctactgaggagtctgaggcatgagaaacgcttgaacctgggaggcggaggttgcagtgagccaagatcgtgccactgcattccagcctggggaacagagcaagtctttgtctcaaaaaaaaaaaaaaaaaaagcactaagttcatgacaggt

SEQ ID NO: 185 - DNA, 1001 bp, Homo Sapiens
  allele 501: 12-468-491 : polymorphic base A or G
  misc_binding 481..500: 12-468-491.mis1, potential
  misc_binding 502..521: 12-468-491.mis2, potential complement
  primer_bind 10..29: upstream amplification primer
  primer_bind 517..537: downstream amplification primer, complement
  misc_binding 489..513: 12-468-491 potential probe
  misc_feature 189,573,901,905: n=a, g, c or t
ccaaagaccgcatagtttctctgatatggttccaaagggatattctttccactgaaacactgtatgtataccagtaaatgcttcctaatggtagatgataaatatttttgttgcttgtagatagaatttttccatctagtgtaagcttaggattgttttctttttcccagtgacatgtacagtttcacntactccacttaaaaaaaatcgttagctcagataaagtgtgtggcacatgaaatgaattttgccaattcaccaccgaaatccctgctttatatctcttcagtggaacactaaaccaacttctttcccaagtacactgatttgatctttacaaattatatgaatgtattaaattatcacatgtgccctgaaactgtgtacatctattatgtatcattagagagatggaaaaaaaaaaaagaaactgcttagtaaagtagaaaaaatagttttaaagtaattttgtaaggctaatggaagacttactgtataaarcaaaaaggattttaaccacattcaaattattgactgttttggggcttttcaggaatcacttaaaaagcaccnaagttcacagccaggcacggtggctcatgcctgtaatcccagcactttgggaggctgaggtgggcagatcacttgaggtcaggagtttgagacaagcctggtcatcatggcaaaatctcatctctactaaaaatacaaaaattagacctggtggcatgtgcctgtaatcccagctactgaggagtctgaggcatgagaaacgcttgaacctgggaggcggaggttgcagtgagccaagatcgtgccactgcattccagcctggggaacagagcaagtctttgtctcaaaaaaaaaaaaaaaaaaagcactaagttcatgacaggttanggtnagcccctcccacccccccccaaagtcatgtgacttcaaatctgggttgtagataaagtttagattagatgtttcagtttctaacatatatgttcct

SEQ ID NO: 186 - DNA, 1001 bp, Homo Sapiens
  allele 501: 12-469-132 : polymorphic base C or T
  misc_binding 481..500: 12-469-132.mis1, potential
  misc_binding 502..521: 12-469-132.mis2, potential complement
  primer_bind 370..387: upstream amplification primer
  primer_bind 812..832: downstream amplification primer, complement
  misc_binding 489..513: 12-469-132 potential probe
  misc_feature 16,226,688,735: n=a, g, c or t
gcccgcggtccccgtnccccgccgggcacccgtgtctggccgcccgcgctgcctttgtcttgccctacgcccccggccctatcgcggtccgcgttctccactgcgcccgggggtcctcgagcgcctcccggccccgggagcatcgtccctgctttcgcctagtccgcgtccagggccatcctcctgactagactcctttcttgttcattcattcttttgggttttnccccttcattccataaacacggattgggcgctgggagggcgtgagcatgaaaaagtgacattaggtgctgcgagtcttcaacctagtgtatctgcagaccggcaactaccatgatccaccttacaggctcaaaattcgcttttgcggtcaatatgaaagagatttaagttttcctagtaggcctgctgcttttagaaatcaggtcttcaggatgtccacttctgccctacctcatgcaggtgtcttttccttaaacctctccaacttctcatctyccctcccctccaaaacacacacacttcatagctataaattgaaaccagtaaattacggctcagtttcctacatgggggaggaaccttccctttcctgtttaattctaagtgggaatgcatttagagtttcaacattaggatttgcttgtgtctttccatggcctaggtccagcaactaaactttacnaaaccagtgttctgcctagagatgaaatgtctctagattctcagtanggttgaaccattgtttattggaatgatctggaatgcagcaatgttaaaactgttgatttagtgtcatctgccaaaactttttgtgccttccctttctgtttttgaaaattacgtgtgtatgcagtacacattaaatgacttcttgagaagtccatctctgtttttgtttttagcttttgccttagatggcttgccacctgtgtaaattgtttatcttttggccagtgttgttatcaatcttggcctaagtgctgacgtgctgttac

SEQ ID NO: 187 - DNA, 1001 bp, Homo Sapiens
  allele 501: 12-469-245 : polymorphic base A or G
  misc_binding 481..500: 12-469-245.mis1, potential
  misc_binding 502..521: 12-469-245.mis2, potential complement
  primer_bind 257..274: upstream amplification primer
  primer_bind 699..719: downstream amplification primer, complement
  misc_binding 489..513: 12-469-245 potential probe
  misc_feature 113,575,622,936: n=a, g, c or t
tcctcgagcgcctcccggccccgggagcatcgtccctgctttcgcctagtccgcgtccagggccatcctcctgactagactcctttcttgttcattcattcttttgggttttnccccttcattccataaacacggattgggcgctgggagggcgtgagcatgaaaaagtgacattaggtgctgcgagtcttcaacctagtgtatctgcagaccggcaactaccatgatccaccttacaggctcaaaattcgcttttgcggtcaatatgaaagagatttaagttttcctagtaggcctgctgcttttagaaatcaggtcttcaggatgtccacttctgccctacctcatgcaggtgtcttttccttaaacctctccaacttctcatcttccctcccctccaaaacacacacacttcatagctataaattgaaaccagtaaattacggctcagtttcctacatgggggaggaaccttccctttcctgtttaattctaagtggraatgcatttagagtttcaacattaggatttgcttgtgtctttccatggcctaggtccagcaactaaactttacnaaaccagtgttctgcctagagatgaaatgtctctagattctcagtanggttgaaccattgtttattggaatgatctggaatgcagcaatgttaaaactgttgatttagtgtcatctgccaaaactttttgtgccttccctttctgtttttgaaaattacgtgtgtatgcagtacacattaaatgacttcttgagaagtccatctctgtttttgtttttagcttttgccttagatggcttgccacctgtgtaaattgtttatcttttggccagtgttgttatcaatcttggcctaagtgctgacgtgctgttacaccagtgcagaatatctcctttcaaaaagttagttttttttttttttnctaagattgggattctacctcctacagctgaagaaattgtgctgttttaaattaggaaagtatga

SEQ ID NO: 188 - DNA, 1001 bp, Homo Sapiens
  allele 501: 12-472-435 : polymorphic base A or G
  misc_binding 481..500: 12-472-435.mis1, potential
  misc_binding 502..521: 12-472-435.mis2, potential complement
  primer_bind 68..86: upstream amplification primer
  primer_bind 533..553: downstream amplification primer, complement
  misc_binding 489..513: 12-472-435 potential probe
gatttgttaaatgtgaagtttgaatgtggccattttccctcccccatacttcatgtcctcacattagagagaggatgatttaagtgaatcaaacccaaggaactggattcttcctggtatatttcactgtaagataggcacaggtacatgtgctctgtatgggttgcataaacatgctttttgatcagaaatataactgcatggagctttttttagcatgtaagtgacactttgaatttgcaggagctgacttttgtttgtttttagatggctttgagtgctgcatctcccttttaccgaggctatgtgtcagacattgattgtcgctggggagtgatttctgcatctgtagatgatagaactcgggaggagcgaggactggaggtgggaattgtttttccttaatagcccttttaagtcaagcaggtaaaatggatcttttgtaactacttgcaatttcaggatgtctccctgcaatttttatctgaaatggggaaaaaratttggtctaggtggggagttaatttttatcgtatgttgatgtctgtatttgttttagcttcatttaaaattagtagtccgatttttctatattttggaagtgctgatggctgtttttaccaaaaggctttttggtgccacatgagtgttttgtatatggtgctttctgctgtggaaagtataatttgttgtcagagattctttttccatgtaaaaggttaggcattgactaataagggtgagatggcacctcttgtttgcatgttgaactgtaaagtaacccttgcatctctccaacaaggggtgtgcatcagaaccacccatggaaatctttgaaaatagacacccagaccctatcctagacctactaaataagaatctctaggatgggacccgaacaagggtgtttttaaaggagccctcataagtggttttgatattctcaaccagggctatactactactgctctggtcttcatgtaattgttcataaattgttg

SEQ ID NO: 189 - DNA, 1001 bp, Homo Sapiens
  allele 501: 12-473-311 : polymorphic base A or C
  misc_binding 481..500: 12-473-311.mis1, potential
  misc_binding 502..521: 12-473-311.mis2, potential complement
  primer_bind 192..210: upstream amplification primer
  primer_bind 740..758: downstream amplification primer, complement
  misc_binding 489..513: 12-473-311 potential probe
taatttttatcgtatgttgatgtctgtatttgttttagcttcatttaaaattagtagtccgatttttctatattttggaagtgctgatggctgtttttaccaaaaggctttttggtgccacatgagtgttttgtatatggtgctttctgctgtggaaagtataatttgttgtcagagattctttttccatgtaaaaggttaggcattgactaataagggtgagatggcacctcttgtttgcatgttgaactgtaaagtaacccttgcatctctccaacaaggggtgtgcatcagaaccacccatggaaatctttgaaaatagacacccagaccctatcctagacctactaaataagaatctctaggatgggacccgaacaagggtgtttttaaaggagccctcataagtggttttgatattctcaaccagggctatactactactgctctggtcttcatgtaattgttcataaattgttgaacatgctttctaagtagaamtaaactttaaaggataattattttgataggtttatcttacgttatagatttatttatttatttgcttttaaccttagtatttattttccctagcttaataagaatgaaagtgatctgcttttaaaagataaaagtatatttaaatcataccagaaaaaaagggtatttaaattgccttcagattttaaaaaacataattttccttaataatactttttagggctcactaactttttttctgtatcttatgttgaggtttttatataattatcatatataaaaatatattccactcattttatatagcatattcatttatatatatttttaatctttagccattgaagaacaataactataggatcagtaaatcccgatatgactcaatagacagctatttatctaagtgtggtgagaaatataatgacatcgacttgacgatagataaagagatctacgaacagctgttgcaggaaggtgggtttctactccatctttct

SEQ ID NO: 190 - DNA, 1001 bp, Homo Sapiens
  allele 501: 12-473-483 : polymorphic base C or T
  misc_binding 481..500: 12-473-483.mis1, potential
  misc_binding 502..521: 12-473-483.mis2, potential complement
  primer_bind 20..38: upstream amplification primer
  primer_bind 568..586: downstream amplification primer, complement
  misc_binding 489..513: 12-473-483 potential probe
cagagattctttttccatgtaaaaggttaggcattgactaataagggtgagatggcacctcttgtttgcatgttgaactgtaaagtaacccttgcatctctccaacaaggggtgtgcatcagaaccacccatggaaatctttgaaaatagacacccagaccctatcctagacctactaaataagaatctctaggatgggacccgaacaagggtgtttttaaaggagccctcataagtggttttgatattctcaaccagggctatactactactgctctggtcttcatgtaattgttcataaattgttgaacatgctttctaagtagaaataaactttaaaggataattattttgataggtttatcttacgttatagatttatttatttatttgcttttaaccttagtatttattttccctagcttaataagaatgaaagtgatctgcttttaaaagataaaagtatatttaaatcataccagaaaaaaagggtatttaaaytgccttcagattttaaaaaacataattttccttaataatactttttagggctcactaactttttttctgtatcttatgttgaggtttttatataattatcatatataaaaatatattccactcattttatatagcatattcatttatatatatttttaatctttagccattgaagaacaataactataggatcagtaaatcccgatatgactcaatagacagctatttatctaagtgtggtgagaaatataatgacatcgacttgacgatagataaagagatctacgaacagctgttgcaggaaggtgggtttctactccatctttctgggtttgaatgtacgcctttagttcttcaaagctcttttacacttttttgctgactcctggtctggtttctatttttagtgcaaagtctttaacttctctcatgaggctacttgttcctaaagtttcaggttccaaatacttgtgagattttcttgatttttagcaaaagga

SEQ ID NO: 191 - DNA, 998 bp, Homo Sapiens
  allele 501: 12-475-85 : polymorphic base T or G
  misc_binding 481..500: 12-475-85.mis1, potential
  misc_binding 502..521: 12-475-85.mis2, potential complement
  primer_bind 566..585: upstream amplification primer, complement
  primer_bind 108..126: downstream amplification primer
  misc_binding 489..513: 12-475-85 potential probe
  misc_feature 555,666,713: n=a, g, c or t
acaccattgaatatgcttggtaaaattctcggtctgcaggacaaatgctaacaagtttagtaatgtgactgcagccttcccagctaatctgctggcaagcgagccctgtgaaaaggcagatgcaggacgagccctttctatgaaaatcaggctgacctcatttgatagttatgcagcctgtgtcgatctcttcccagggcagcaggtagcaggccagaatcagaaccccaagtcaggagctttaacttatctgagattttcatcctttagcatgaatttcaaatatggcagggaaggagattgaattcacaaaaacctaaatcttccaaatcccacaggttacagttactctgttggtgggatccactataacacccaggtacgattcctgaatgggaacctgatgctgcctttgtgagatgtggttatgacacagtgtctgcactcagattcgtatgatggtggaatggcattaaacttggaggtcttgaagccctgtcktcctgtccctggaggcataggtgacccccagtgagcactagcagtcactttggnacttagaattcctgtatttagcattgactctcacttagtctctttagaaaactctcttttttctctctgttaggttgattagtctaacttcagttcctaggaactaaaatncctgaatttctcataggcagtctgaatttagggcagcctaatttatnaacatgccttagaaggaaatcatgtgtgcattcttgcttgctcagcccaagaagtgtatcaggccctgagcggggcaccgcccactgggggatgtgttctctgtcttgtccccatgctaaagccctaaactctcctgcacctagagggaaccgctgcagaaattctccatgattctcacccactacagtgccccagctctggctactgcagggcagttgatccaaagcagcttctgtctggggatcaggatactgtttcttgtcaaccacgtggtgactagaact

SEQ ID NO: 192 - DNA, 985 bp, Homo Sapiens
  allele 485: 12-475-446 : polymorphic base G or A
  misc_binding 465..484: 12-475-446.mis1, potential
  misc_binding 486..505: 12-475-446.mis2, potential complement
  primer_bind 911..930: upstream amplification primer, complement
  primer_bind 453..471: downstream amplification primer
  misc_binding 473..497: 12-475-446 potential probe
  misc_feature 47,196,202..203,900: n=a, g, c or t
cattctgcaaaaactgaagcatcgagaagttaccaagattcaaactngattgactccaaagcctgcactcttagctgctcccccacctattaccgcccaaataggcaggaggaaaagagctctgtgacagttttaataggctccaaacagagatgagattgagggtggcgaggaagagaagaaagaatagagaaangggatnnggtggtaatgcaggaagtaggctttttgttttttaatgaaaatatgaatatgtcatcagccacagatccacgcttaagcattttttggtaccccatagcaggtaattctcttctagtgaaatgccagcactctttcaaaacgacaccattgaatatgcttggtaaaattctcggtctgcaggacaaatgctaacaagtttagtaatgtgactgcagccttcccagctaatctgctggcaagcgagccctgtgaaaaggcagatgcaggacgagccctttctrtgaaaatcaggctgacctcatttgatagttatgcagcctgtgtcgatctcttcccagggcagcaggtagcaggccagaatcagaaccccaagtcaggagctttaacttatctgagattttcatcctttagcatgaatttcaaatatggcagggaaggagattgaattcacaaaaacctaaatcttccaaatcccacaggttacagttactctgttggtgggatccactataacacccaggtacgattcctgaatgggaacctgatgctgcctttgtgagatgtggttatgacacagtgtctgcactcagattcgtatgatggtggaatggcattaaacttggaggtcttgaagccctgtcgtcctgtccctggaggcataggtgacccccagtgagcactagcagtcactttggnacttagaattcctgtatttagcattgactctcacttagtctctttagaaaactctcttttttctctctgttaggttgattagtct

SEQ ID NO: 193 - DNA, 1001 bp, Homo Sapiens
  allele 501: 12-477-100 : polymorphic base G or A
  misc_binding 481..500: 12-477-100.mis1, potential
  misc_binding 502..521: 12-477-100.mis2, potential complement
  primer_bind 580..600: upstream amplification primer, complement
  primer_bind 62..82: downstream amplification primer
  misc_binding 489..513: 12-477-100 potential probe
  misc_feature 368: n=a, g, c or t
tcagttactgtgacctaccatatcatggttgaattcctccatgttaagaccctactgtctagaagtatggtgttagcagatgtactcattgattggtactgtctgtagtttcattttgaagcataaacctgagtaacattcagtaagactctgtatgttcagaaaagatgtcacaatattaattgagcctctaacatcactatttatgtttctgaacatttttacatactgtcaaggcatctgaatatattcttaaagttagaaaactgtatatgaagcattactgatattgctggtattactggaaagaccatatcctaacgagcttgctaattagtactctgtttctacatttcatgatataatcnaggtgtttttaaaaaaacattttaacagctttattgagttataattaacataaagttaactgcacatatttaaaatgtacaatttggtaagttttgatatatgtatacatcataaaatcacctctgataatargtatattcattatctccaaaaatgtcatcatgcccctttggtaatttcttcctctggccatcccatgcagctgatttgctttctgtagtttgcattttctagattttcatatttaagaaatcatagtttgcatttgatatctagtttcatatacctaggaaatcatccagcatatcctcttttggtctgccttcttagagtctacataaatattttgagatccatccatgttgttacatgtgtcagtagttcattccttttcgtcgctgagtaatatttcattccatggttataccagtttgtttatacattcaccatttgtgttgcattcagtttttcactattataaaaaaattatatgaacattaacatacaagtttgtatgtatggactaatgcttttcttcatcttattaccctaggagtagcgtgttgttaactttttaaggaaactataataccaaacttttccagggtggttataccattttgcattctcac

SEQ ID NO: 194 - DNA, 1001 bp, Homo Sapiens
  allele 501: 12-477-331 : polymorphic base G or A
  misc_binding 481..500: 12-477-331.mis1, potential
  misc_binding 502..521: 12-477-331.mis2, potential complement
  primer_bind 812..832: upstream amplification primer, complement
  primer_bind 294..314: downstream amplification primer
  misc_binding 489..513: 12-477-331 potential probe
  misc_feature 600: n=a, g, c or t
gtgtaacaaaggaggaaaggtgagaaataccattggatagtatgtgaaggttattgtgcagtttagtgttgtaaatgcagtgaataggtttagccagcttgtagaagtctttgtctagttctcaaaaagtagaggttatgttgtactttaaaagcatgagaaaagtagaatcgaaaaaaagtgtattagtcttctatacctatctcctacagaaaaaatcttttaagacttatcagttactgtgacctaccatatcatggttgaattcctccatgttaagaccctactgtctagaagtatggtgttagcagatgtactcattgattggtactgtctgtagtttcattttgaagcataaacctgagtaacattcagtaagactctgtatgttcagaaaagatgtcacaatattaattgagcctctaacatcactatttatgtttctgaacatttttacatactgtcaaggcatctgaatatattcttaaagttagaaaactrtatatgaagcattactgatattgctggtattactggaaagaccatatcctaacgagcttgctaattagtactctgtttctacatttcatgatataatcnaggtgtttttaaaaaaacattttaacagctttattgagttataattaacataaagttaactgcacatatttaaaatgtacaatttggtaagttttgatatatgtatacatcataaaatcacctctgataataagtatattcattatctccaaaaatgtcatcatgcccctttggtaatttcttcctctggccatcccatgcagctgatttgctttctgtagtttgcattttctagattttcatatttaagaaatcatagtttgcatttgatatctagtttcatatacctaggaaatcatccagcatatcctcttttggtctgccttcttagagtctacataaatattttgagatccatccatgttgttacatgtgtcagtagttcattccttttcgtcgct

SEQ ID NO: 195 - DNA, 1001 bp, Homo Sapiens
  allele 501: 12-477-332 : polymorphic base T or C
  misc_binding 481..500: 12-477-332.mis1, potential
  misc_binding 502..521: 12-477-332.mis2, potential complement
  primer_bind 813..833: upstream amplification primer, complement
  primer_bind 295..315: downstream amplification primer
  misc_binding 489..513: 12-477-332 potential probe
  misc_feature 601: n=a, g, c or t
agtgtaacaaaggaggaaaggtgagaaataccattggatagtatgtgaaggttattgtgcagtttagtgttgtaaatgcagtgaataggtttagccagcttgtagaagtctttgtctagttctcaaaaagtagaggttatgttgtactttaaaagcatgagaaaagtagaatcgaaaaaaagtgtattagtcttctatacctatctcctacagaaaaaatcttttaagacttatcagttactgtgacctaccatatcatggttgaattcctccatgttaagaccctactgtctagaagtatggtgttagcagatgtactcattgattggtactgtctgtagtttcattttgaagcataaacctgagtaacattcagtaagactctgtatgttcagaaaagatgtcacaatattaattgagcctctaacatcactatttatgtttctgaacatttttacatactgtcaaggcatctgaatatattcttaaagttagaaaacygtatatgaagcattactgatattgctggtattactggaaagaccatatcctaacgagcttgctaattagtactctgtttctacatttcatgatataatcnaggtgtttttaaaaaaacattttaacagctttattgagttataattaacataaagttaactgcacatatttaaaatgtacaatttggtaagttttgatatatgtatacatcataaaatcacctctgataataagtatattcattatctccaaaaatgtcatcatgcccctttggtaatttcttcctctggccatcccatgcagctgatttgctttctgtagtttgcattttctagattttcatatttaagaaatcatagtttgcatttgatatctagtttcatatacctaggaaatcatccagcatatcctcttttggtctgccttcttagagtctacataaatattttgagatccatccatgttgttacatgtgtcagtagttcattccttttcgtcgc

SEQ ID NO: 196 - DNA, 1001 bp, Homo Sapiens
  allele 501: 12-477-44 : polymorphic base C or G
  misc_binding 481..500: 12-477-44.mis1, potential
  misc_binding 502..521: 12-477-44.mis2, potential complement
  primer_bind 524..544: upstream amplification primer, complement
  primer_bind 6..26: downstream amplification primer
  misc_binding 489..513: 12-477-44 potential probe
  misc_feature 312: n=a, g, c or t
gtctagaagtatggtgttagcagatgtactcattgattggtactgtctgtagtttcattttgaagcataaacctgagtaacattcagtaagactctgtatgttcagaaaagatgtcacaatattaattgagcctctaacatcactatttatgtttctgaacatttttacatactgtcaaggcatctgaatatattcttaaagttagaaaactgtatatgaagcattactgatattgctggtattactggaaagaccatatcctaacgagcttgctaattagtactctgtttctacatttcatgatataatcnaggtgtttttaaaaaaacattttaacagctttattgagttataattaacataaagttaactgcacatatttaaaatgtacaatttggtaagttttgatatatgtatacatcataaaatcacctctgataataagtatattcattatctccaaaaatgtcatcatgcccctttggtaatttcttcctctsgccatcccatgcagctgatttgctttctgtagtttgcattttctagattttcatatttaagaaatcatagtttgcatttgatatctagtttcatatacctaggaaatcatccagcatatcctcttttggtctgccttcttagagtctacataaatattttgagatccatccatgttgttacatgtgtcagtagttcattccttttcgtcgctgagtaatatttcattccatggttataccagtttgtttatacattcaccatttgtgttgcattcagtttttcactattataaaaaaattatatgaacattaacatacaagtttgtatgtatggactaatgcttttcttcatcttattaccctaggagtagcgtgttgttaactttttaaggaaactataataccaaacttttccagggtggttataccattttgcattctcactagcagagtatgccagttcagttcatccacattcttgttaacaccggtatgggcag

SEQ ID NO: 197 - DNA, 1001 bp, Homo Sapiens
  allele 501: 12-478-223 : polymorphic base G or A
  misc_binding 481..500: 12-478-223.mis1, potential
  misc_binding 502..521: 12-478-223.mis2, potential complement
  primer_bind 704..723: upstream amplification primer, complement
  primer_bind 234..254: downstream amplification primer
  misc_binding 489..513: 12-478-223 potential probe
  misc_feature 35,194,272,317,458: n=a, g, c or t
tcttgctctgtcacccaggctagagtgcagtgacnaccatcacagtgtgctgcagccgcagcctcccaggctcaagctgtttagatcgtatttctaagttgcgcttcaaaaacgcattgacacaggctcaggctaggcttcttaaaataagatatagagcacaaattaattatttcttaataggcattacaaangattcaggttccttctataggtcatagcgtattctgtaacacaaaaagcaaagttgtcgcatctctctatcttttttnagctgtcactggacattgattcaacagcatttattgtccgttaancccctacccacccccagaagttcccttgtgccctttgcacgtgtgtgcatgcgtgtatgctagagagagagggggagagcacttcagttgattctggttttccttcagacaccacctttgagaaactgccttaaagagtgntgtggtcattaattagatgaaggggagaaaggaaggcattatrgtcaaaagaacagtgtaacaaaggaggaaaggtgagaaataccattggatagtatgtgaaggttattgtgcagtttagtgttgtaaatgcagtgaataggtttagccagcttgtagaagtctttgtctagttctcaaaaagtagaggttatgttgtactttaaaagcatgagaaaagtagaatcgaaaaaaagtgtattagtcttctatacctatctcctacagaaaaaatcttttaagacttatcagttactgtgacctaccatatcatggttgaattcctccatgttaagaccctactgtctagaagtatggtgttagcagatgtactcattgattggtactgtctgtagtttcattttgaagcataaacctgagtaacattcagtaagactctgtatgttcagaaaagatgtcacaatattaattgagcctctaacatcactatttatgtttctgaacatttttacatactgtcaaggcatctgaatatattcttaa

SEQ ID NO: 198 - DNA, 1001 bp, Homo Sapiens
  allele 501: 12-478-320 : polymorphic base G or A
  misc_binding 481..500: 12-478-320.mis1, potential
  misc_binding 502..521: 12-478-320.mis2, potential complement
  primer_bind 801..820: upstream amplification primer, complement
  primer_bind 331..351: downstream amplification primer
  misc_binding 489..513: 12-478-320 potential probe
  misc_feature 132,291,369,414,555: n=a, g, c or t
cattaacagtaattttttattgtatttcttttcttttttttaatattatgtatttatgtatttatttatttatttatttattttgagacagggtctttcttgctctgtcacccaggctagagtgcagtgacnaccatcacagtgtgctgcagccgcagcctcccaggctcaagctgtttagatcgtatttctaagttgcgcttcaaaaacgcattgacacaggctcaggctaggcttcttaaaataagatatagagcacaaattaattatttcttaataggcattacaaangattcaggttccttctataggtcatagcgtattctgtaacacaaaaagcaaagttgtcgcatctctctatcttttttnagctgtcactggacattgattcaacagcatttattgtccgttaancccctacccacccccagaagttcccttgtgccctttgcacgtgtgtgcatgcgtgtatgctagagagagagggggagagcacttcarttgattctggttttccttcagacaccacctttgagaaactgccttaaagagtgntgtggtcattaattagatgaaggggagaaaggaaggcattatggtcaaaagaacagtgtaacaaaggaggaaaggtgagaaataccattggatagtatgtgaaggttattgtgcagtttagtgttgtaaatgcagtgaataggtttagccagcttgtagaagtctttgtctagttctcaaaaagtagaggttatgttgtactttaaaagcatgagaaaagtagaatcgaaaaaaagtgtattagtcttctatacctatctcctacagaaaaaatcttttaagacttatcagttactgtgacctaccatatcatggttgaattcctccatgttaagaccctactgtctagaagtatggtgttagcagatgtactcattgattggtactgtctgtagtttcattttgaagcataaacctgagtaacattcagtaagactctgtatgtt

SEQ ID NO: 199 - DNA, 1001 bp, Homo Sapiens
  allele 501: 12-479-289 : polymorphic base G or T
  misc_binding 481..500: 12-479-289.mis1, potential
  misc_binding 502..521: 12-479-289.mis2, potential complement
  primer_bind 213..230: upstream amplification primer
  primer_bind 678..698: downstream amplification primer, complement
  misc_binding 489..513: 12-479-289 potential probe
  misc_feature 444,957..958: n=a, g, c or t
ctctcctgttactcccccttctctcactccactccagccatactagcctccttactgttctttgaccactctagcttccctccctgcctgaggcctttgtatcagctgttccctctgcctggaatggctgaatttccttacctccttcaaatccttgcttaatccctccttctcaaagagacctaaacaccctggccaccttctttaatataatattctgaccatgcacctaacctcacaccctgatcccctgctctaatctgtctttttcataatgtttatcaacttctgactttctatatagttatttattgtgcatgttgtgtgcctccccttgctaaaatgtaagctccacaagggcaggcatgcttgtttgttatagtcagtgatgtatcctaagcacctagaacagtacttgcctgatggtgagtgctcaatgaacantttgcagaaaaatgaatgaatgaatgccaggcattcataagcccacaaaaaaaatckatgtgtcattctacaccttcactgtagcctaatgcttcatgctccaaaaagaaagaagaggcatcattttctctgtttcctgtgctccacctctcgcacattccccactctcctagctgctgtctttcccctgacttttttgtctagtaacaagaactccctgcctggtgaaagtcggcattttcttctcaatttacttctaaatattagtgcttttgtttaccctgtgaagcagatggtaacagttaatgtaataaccagactgtctcctctctcttgtttgacacagtagatgtcatgagccatattttcccttggttatatttgttaaatagaagacaggagatctgctatatggtcaacattaggtctggtcactgcttttatattgttaacactgtgtttcctttcatatatttacatcatttggaaacatttgccctagttccagcaatnnaggctaagagataaggatccaaatgaaagaaagaggataaaaa

SEQ ID NO: 200 - DNA, 1001 bp, Homo Sapiens
  allele 501: 12-482-237 : polymorphic base G or A
  misc_binding 481..500: 12-482-237.mis1, potential
  misc_binding 502..521: 12-482-237.mis2, potential complement
  primer_bind 720..737: upstream amplification primer, complement
  primer_bind 223..243: downstream amplification primer
  misc_binding 489..513: 12-482-237 potential probe
  misc_feature 552,561,757,831,845: n=a, g, c or t
ttctcttgggactcatatcactaatctaggcaagttaagaatgttttctctgtttgggctgagacaatattgagaaagttactccacctaatcctataggaaattaattgatttttgtgcagtattaaaattgagattaatgtgttataaataaaaagcagcctgctctgtgctacagaaaactagatcagggagaggccacatttattttaatttctaaaagtgtaaacctttcatagtatcatgtgaaattctttagtatgaatagacatttcaaagtaggaggaaaaaaacctattttctcaaaatatatgaaatgttagcagaatttgatacagctttagacaaaactgctaaaacattttctttttggaacatagaacaatttaattattacagtatccacagtcatcaaatatatatatatttaaatcatcaaatatatatgtttaaaatatagttgtgtgtgtgatgttatgtatgtataatgtcatgtacacraaagcacatacagtttctactttgtacttactggtcccctaaaagtgcttnggagattanccatgtcaaacagtggttttcctatttgtgatgtcatcattagacatatctaacatgggagtccatctttaaaaatctgagccatatgtaattttattacatctgtattagaatctcatattcagttttctactttttaaaacacagctcctcttttagtcttgtcagtcaggttgtcctatgttactgtgggtgntttaaaaattaagtagcatcactatggctaacacctctttgggtgctccaagtttgggaagtgaatgccatccnaacttgatggttgnagatttcttttaaaaaaaaatttgtcattaccattttgctgtgagaggaaacagtcttctgggcagaaggcattgagtccctaactttaaaacagtttataacctagagggtgactacttggcatgatctctgtggggtggatgcagtgatctgcg

SEQ ID NO: 201 - DNA, 1001 bp, Homo Sapiens
  allele 501: 12-482-285 : polymorphic base T or A
  misc_binding 481..500: 12-482-285.mis1, potential
  misc_binding 502..521: 12-482-285.mis2, potential complement
  primer_bind 768..785: upstream amplification primer, complement
  primer_bind 271..291: downstream amplification primer
  misc_binding 489..513: 12-482-285 potential probe
  misc_feature 600,609,805,879,893: n=a, g, c or t
cccgcaactctcactgtctttctctattttattaaagtcttgaaatttttctcttgggactcatatcactaatctaggcaagttaagaatgttttctctgtttgggctgagacaatattgagaaagttactccacctaatcctataggaaattaattgatttttgtgcagtattaaaattgagattaatgtgttataaataaaaagcagcctgctctgtgctacagaaaactagatcagggagaggccacatttattttaatttctaaaagtgtaaacctttcatagtatcatgtgaaattctttagtatgaatagacatttcaaagtaggaggaaaaaaacctattttctcaaaatatatgaaatgttagcagaatttgatacagctttagacaaaactgctaaaacattttctttttggaacatagaacaatttaattattacagtatccacagtcatcaaatatatatatatttaaatcatcaaatatatatgtttawaatatagttgtgtgtgtgatgttatgtatgtataatgtcatgtacacaaaagcacatacagtttctactttgtacttactggtcccctaaaagtgcttnggagattanccatgtcaaacagtggttttcctatttgtgatgtcatcattagacatatctaacatgggagtccatctttaaaaatctgagccatatgtaattttattacatctgtattagaatctcatattcagttttctactttttaaaacacagctcctcttttagtcttgtcagtcaggttgtcctatgttactgtgggtgntttaaaaattaagtagcatcactatggctaacacctctttgggtgctccaagtttgggaagtgaatgccatccnaacttgatggttgnagatttcttttaaaaaaaaatttgtcattaccattttgctgtgagaggaaacagtcttctgggcagaaggcattgagtccctaactttaaaacagtttataacctaga

SEQ ID NO: 202 - DNA, 1001 bp, Homo Sapiens
  allele 501: 12-482-482 : polymorphic base T or A
  misc_binding 481..500: 12-482-482.mis1, potential
  misc_binding 502..521: 12-482-482.mis2, potential complement
  primer_bind 965..982: upstream amplification primer, complement
  primer_bind 468..488: downstream amplification primer
  misc_binding 489..513: 12-482-482 potential probe
  misc_feature 67,797,806: n=a, g, c or t
tctgcagtaagagaaatgttctactctatactatccattagggagtaggaaactgatttttttattnttatgttaagtaattttaaatccacacagccacatgtgcttagtgactagcataatggacaacacaattttttgtgttcctttggtgacaggtgacattttctccctgtatgagagtcctcccagtttaccccgcaactctcactgtctttctctattttattaaagtcttgaaatttttctcttgggactcatatcactaatctaggcaagttaagaatgttttctctgtttgggctgagacaatattgagaaagttactccacctaatcctataggaaattaattgatttttgtgcagtattaaaattgagattaatgtgttataaataaaaagcagcctgctctgtgctacagaaaactagatcagggagaggccacatttattttaatttctaaaagtgtaaacctttcatagtatcatgtgaaattctwtagtatgaatagacatttcaaagtaggaggaaaaaaacctattttctcaaaatatatgaaatgttagcagaatttgatacagctttagacaaaactgctaaaacattttctttttggaacatagaacaatttaattattacagtatccacagtcatcaaatatatatatatttaaatcatcaaatatatatgtttaaaatatagttgtgtgtgtgatgttatgtatgtataatgtcatgtacacaaaagcacatacagtttctactttgtacttactggtcccctaaaagtgcttnggagattanccatgtcaaacagtggttttcctatttgtgatgtcatcattagacatatctaacatgggagtccatctttaaaaatctgagccatatgtaattttattacatctgtattagaatctcatattcagttttctactttttaaaacacagctcctcttttagtcttgtcagtcaggttgtcctatgttactgtgggtg

SEQ ID NO: 203 - DNA, 1001 bp, Homo Sapiens
  allele 499: 12-483-322 : polymorphic base T or A
  misc_binding 479..498: 12-483-322.mis1, potential
  misc_binding 500..519: 12-483-322.mis2, potential complement
  primer_bind 802..820: upstream amplification primer, complement
  primer_bind 311..331: downstream amplification primer
  misc_binding 487..511: 12-483-322 potential probe
  misc_feature 253,301..302,345,368,400,565,570,968,973,978: n=a, g, c or t
agacactttgaaatgtctttgcttaaaaacaattgttttaagtgcactgcaaaagcattacatggtctagcctcataataattctccctttttggagacccaggattcagtgtgggctctgcccagatttcagagatctaggcaaaaaagaaataatccctatatgaataaaattggtctcctcatacaatcccatgatagagttctataattttatgtttgatttggcatccatctttattctccctctagncaccactagactttttctgtctgtaccttgagatataaattttgctanntgatttttcatctaagagttgtttccttcaatatgcaggtttnagggctatttagctgacaactgnccaggttaatgaaacaggttatcatgagtttngcaagtctaagacaggggaaaacaaaaggaggtcttaggaatctataagatgtacttctatcagtatgcctaatacatctatgtatctatgtgttatgwacacgtttcactactaaaaacatataaaagagctgtaattaattggcttgcagaaaaataaaggtngcttnaaatccaatgctttatcagagaaaagaaaagactagccaaatgctttttcaagtttatgtgatttaagtaaaatctttaataaataagctagctttaaaattactggcaaagtaatattagaaatgtcttaagaattgccagcatacattttcgtttgcatttatggatcaagtcatttcatatttatccctgccaaatactgtaaggtgtcaaagtttggcatagggttacaaaactataaacccagcctaaaacagaatgatttttgtttgtgttaatttttaataaataagacattgatattggtttaatgaaaatagctacatcttgaattatttagtaaaattactgtaacttctaatcttgtggccttagggagtctagtccacaggcaatnaaggntttcnttttgggaaatgactgttatcat

SEQ ID NO: 204 - DNA, 1001 bp, Homo Sapiens
  allele 501: 12-484-46 : polymorphic base G or A
  misc_binding 481..500: 12-484-46.mis1, potential
  misc_binding 502..521: 12-484-46.mis2, potential complement
  primer_bind 528..546: upstream amplification primer, complement
  primer_bind 86..106: downstream amplification primer
  misc_binding 489..513: 12-484-46 potential probe
tgtgagcaagaagtgtggggagtggttgtaaaggggcacagtatttacacaacatctgttttgtaaacacaaagccctctgaaaaggggatactagaaatgaggtgtctttggcaggtgcagtgatggcaagactgcacacaattaattcttgaaaacaaatcccatctatttagttcttcaatttgttgtagattaggctgtcctgggttcacactgcccgaggtcaaacccaacccagtggaaggaggagcttccaagtccctcttctttccagatgaagcaataaacaagcaccctcgcttcaggtgagtatggctttgtgttgaaatgcagatgcccttcactagacccctgacttctgagagtatagtatttctgtctagaaatcctttttgagcattaactgagttttggctctcttcctaagtaaccagagaagatagcagatgtgcacctgttcacatcttcagtacccccaggcttcttggttgttgatgcrtgcaccaggcttgatttgtcaattctccaagtcgtcacaaagttattcgctgagccactgcgaataactcttttaatagggagattattttcagtcctaggtctgtaaatgcctactgggatttttttttctcttagttatttctccttttttgtcctctctaaccatcagtatctgtgatttgcccatcttactctatataacttataaaataggtgcagtacctgatatatataataggcactctcttccattaacttcaagttctgttggtttgttgttcaattctgaggttttaagttgctttaaggctctcactagtctgatcttagctttgtacaatgcatgctcatctgtcatcctgagcctaggctcctgatccagagtgggaacatggagacttctcagcgttcattcctttaacaggccctcacgtttgctatgtgcagagccttttggggaagacagatatttgtagacgtagtttctaacttcatatg

SEQ ID NO: 205 - DNA, 1001 bp, Homo Sapiens
  allele 501: 12-490-312 : polymorphic base A or T
  misc_binding 481..500: 12-490-312.mis1, potential
  misc_binding 502..521: 12-490-312.mis2, potential complement
  primer_bind 189..209: upstream amplification primer
  primer_bind 621..641: downstream amplification primer, complement
  misc_binding 489..513: 12-490-312 potential probe
  misc_feature 437,543,597,604,664,732,872,932: n=a, g, c or t
cgctgagtcacggggaggcggtgccgcgcgcgggggaggcgggcccgcgcagtcacgtggcgggggctgtatcacaacaactgcgcggcgtgcgccgcccgcggcccacaccgcttcctcccgcgacaggccggctctccgagcatgctcagcttggcctcacgactgcacggcgtccccccatgcggatctccacggtccaggttttccggacggctctgggggcggggcctgtgttggtccgcggggctgcgaggcgaggttgcggtgccagggcgccgctgggcagagatgggttcctggagagcgggtctcgcgtttttccgcggaagacactactgggaatcggcctttggtcatggtctagggaagagctgattctgcaagatatgagctccttctttccccttcagctatcgttacagccctgatggagnctgtctgctgaaaactcacttccagatgtcgaaacctggccctgggtgcagtctacagaatgawatcgagcagtagtggacctatgcaggcaaagcattgtcaganggggagtaactcttgttaaatatgacttcagttgatccgtgatgggatttttgnttttttnctttgtaacagaaaaggctaaagacactgagagatcaaggtttaaattgggcataactgnccctgtggtgcagcagcgccggcgccctttttgggattgtccaaagctctgggacccccgctgggggnagctggttcagaattcgggggggtaggatagggtgagggaggtcccttatgtgagtgtgagccgggatctaggacagagtaactccaattacagtgttaaactcttactaggttcagtgtcgcgtagggctttggctagnactagaatttagtctattattgaaccgcccaggtccatgattcctaacaggtgcatgggnaaaagtgtatggtgtgcagcaggtgtatgggaaaactgctttgcaaagtgtaaatcaaggtctacatca

SEQ ID NO: 206 - DNA, 1001 bp, Homo Sapiens
  allele 501: 12-491-295 : polymorphic base G or A
  misc_binding 481..500: 12-491-295.mis1, potential
  misc_binding 502..521: 12-491-295.mis2, potential complement
  primer_bind 777..795: upstream amplification primer, complement
  primer_bind 266..286: downstream amplification primer
  misc_binding 489..513: 12-491-295 potential probe
  misc_feature 128,300,307,312,357: n=a, g, c or t
tgcaggcagaaatgaaaaaagaaatcctgaaactttaagaatcggggataatatcagataagtatgttgcttaaatttgactaatttaaaccatttttataaattagtcactcagcatgaagacatcnaaaaattcttcctaaattctaaacactatgtacatttgaatgctgagttagtcccaggattcatccccaaaatatcactgaccagtatgatttaatattagtatttgccctctcaggggcatccttgctgcaggatatcacaagggtagaaggtaaagcagctgcacaaaancatcttntgctncttgtttgttactctgagatgatcctctgcctgaaaatatctaangcagatacttttctcagctttgcaatgcaaatgatatttaacagttccctaggaatgttttgtgtgcttatcaaatttcagctaaacacatttatttatatgataaatatgataaccaaaaggttccatgtattatcttttcartattcatgttatactgtacaagcactgtattatacaaatactgtataatatagtattgtaaggtacaaaaatacaataaactaaccatacttcaactctgcggggttgctgtgggagagctctgcagggttgctgtgcaagccccaggtaagtgattaagtcagacaataactacatcagtgcttctcaaattttcatgtgcctgcagattatcggttgggggcggggagtttttaatatgcattctgacttagtaggcctggtgtcaggccagagattctgcgtctctcccaagctttcaggtgatacagatgctgactggtggaccacattttgagtagcaagatgctaaagcttcttacaactctaaactttcaaaatcctttataaaaggatagctataatgtatatgtgaaatggactatggaaacataaaataataaaagcttactattgtcagtcacttgggaagtgtcacttttggaagttagtcacttccc

SEQ ID NO: 207 - DNA, 1001 bp, Homo Sapiens
  allele 501: 12-493-417 : polymorphic base G or C
  misc_binding 481..500: 12-493-417.mis1, potential
  misc_binding 502..521: 12-493-417.mis2, potential complement
  primer_bind 90..109: upstream amplification primer
  primer_bind 514..534: downstream amplification primer, complement
  misc_binding 489..513: 12-493-417 potential probe
  misc_feature 590,704,1000: n=a, g, c or t
aatgttaatttttctcacctttattttcaataggtggaatacatgttggtatcttttgatcatgaaaataaaaaagtccggttggtcctgtctggggagaaagttcttgaaactctgcaagagaagggggaaaggacaaacccaaagtaagctctcatgtgctgatttagtgtttctgaaactgctaaaacttctagaatatagagttttttctcaattattggaggcaggatagcctaacagttaagagtacaggctctggtttcaggttgccatagtttcaaatcatggttcctttactcaatagctgaataaccttgggcaagttacttaacttttctgtgcctcagttctctcatctgtaaagtaaagatcatagcaatacctacctaaggtgttggaattaaatacattaatatatgaagcactttgtacagtaaactaaatataaagcctgttttttattaaaacatttttgggaaaaaatgtattgcagaagcstataactgggatcacaaaccatgatgcaagatataagttgcagatgggctttgtttggctttgtttggctggcatgatttttttttgangacggagtctcactctgtcgtccgggctggagtgcagtggcacgatctcagctcactgcaagctccacctcctggcttcacgccattctcctgcctcaccctcccgagtagctngggactacaggcgcccgccaccacgcctggctaattttttgtatttttagtagagacgggggtttcaccgtgttagccaggatggtctccatttcctgacctcatgatctgcccgcctcagcctcccaaagtgctgggattacaagcatgagccaccgcacccggcctggtgtgtttttaaggtattcctacatttaagtagacagagacggggaggggaggggaatatatactcctctgctcattttccactcattcgttttggggaagctgcatttgagtttggagggcagcant

SEQ ID NO: 208 - DNA, 1001 bp, Homo Sapiens
  allele 501: 12-494-373 : polymorphic base C or T
  misc_binding 481..500: 12-494-373.mis1, potential
  misc_binding 502..521: 12-494-373.mis2, potential complement
  primer_bind 127..144: upstream amplification primer
  primer_bind 571..591: downstream amplification primer, complement
  misc_binding 489..513: 12-494-373 potential probe
  misc_feature 2,4,8,15,19,33,36,296,311,640,899: n=a, g, c or t
antncagnccgggcnatanagttagatcctgtntcnaaaaaaaaaaaaaaagaaaagaaaagaaaacaaaagtcttgggttctagtcccactttactgctgattaacattttaacttgaagagtgattcaatcactcggttgccccacttgaaaaaaaaaaaaagctggagtacatatctagaatccttaccacacgaacattctatatttttggttctttgactctaaaatggtcagcttaaaagagtgttttccatccctcttttggctgttagagccatccctggtgactttnacccctttcccctgnaacctttcatatgtttattgagcatccactccagttgtgcactggtgtttgttttcacggggttactggtaccctccaccctcacccctctttctccctgcagaaagcttttctaatactttcagccgtggtcaatttcaggtgatagcaatggtaatcatttattgagtacttaccaaatgctagagaytgacacaggctatgtcattttttcaataccaagccctgtgaaatgggtactatcagaccatttttacacctgtggcttagaagacttaaatgtctagtgtaagggcggttgtagtggtaggcagaggcaggtctcaaanccctcgcctacctaactcagacacacttggcaatactatatatctctttaagcctttcagaggatatgttttaggaggtggattgttccattttatatatatatgaacatgatagacagacagatagatagataaatagatagagataattttaaacgtgctcactttcatttatgaaaatttacatttgataactaaaagagccttgcaattccagcatctccctcatggtggcagtagaagactaagtcatgtacancgcagcctccagcaccaacaactaacccagaagaaacctccttaataaatcagcttttggtcaagattggtgttacgtaaaatgcaaaattaggaccctcgg

SEQ ID NO: 209 - DNA, 1001 bp, Homo Sapiens
  allele 501: 12-495-166 : polymorphic base C or T
  misc_binding 481..500: 12-495-166.mis1, potential
  misc_binding 502..521: 12-495-166.mis2, potential complement
  primer_bind 336..355: upstream amplification primer
  primer_bind 784..802: downstream amplification primer, complement
  misc_binding 489..513: 12-495-166 potential probe
  misc_feature 146,405,641,702,965: n=a, g, c or t
tagagactgacacaggctatgtcattttttcaataccaagccctgtgaaatgggtactatcagaccatttttacacctgtggcttagaagacttaaatgtctagtgtaagggcggttgtagtggtaggcagaggcaggtctcaaanccctcgcctacctaactcagacacacttggcaatactatatatctctttaagcctttcagaggatatgttttaggaggtggattgttccattttatatatatatgaacatgatagacagacagatagatagataaatagatagagataattttaaacgtgctcactttcatttatgaaaatttacatttgataactaaaagagccttgcaattccagcatctccctcatggtggcagtagaagactaagtcatgtacancgcagcctccagcaccaacaactaacccagaagaaacctccttaataaatcagcttttggtcaagattggtgttacgtaaaatgcaaaattaggaycctcggaaggggaaaaaaagagtctcaagtatctaggttattgaccccagaaacaaaagaaatttgacaaacttgcaaaacagagacaacaacttcctatgggggtaaaaaaaacaaagcaactacttgttgctgcccancccgtttagtaactggccttggtagtcttccagcagcaagcacaatagccttgtccacagnatgcttttcccatttcctcggtccccttgaaaccaagcttttgagaacaaatagttcatttctcctttcttaatttgctctgaaggtttttaacacagcgataactggcatatagaaatttcacatatttttcttgatcactatggcctatcaacccccgcctgatgattaaatgaaggacgatgtatccaaggttcttaaagaacttggttgcaacgaatgaacacaaaaaacaccagacaataaacatgtattgaattatnatctgggtacagtagacaccattgggcagacttcag

SEQ ID NO: 210 - DNA, 1001 bp, Homo Sapiens
  allele 501: 12-495-272 : polymorphic base A or T
  misc_binding 481..500: 12-495-272.mis1, potential
  misc_binding 502..521: 12-495-272.mis2, potential complement
  primer_bind 230..249: upstream amplification primer
  primer_bind 678..696: downstream amplification primer, complement
  misc_binding 489..513: 12-495-272 potential probe
  misc_feature 40,299,535,596,859: n=a, g, c or t
taagggcggttgtagtggtaggcagaggcaggtctcaaanccctcgcctacctaactcagacacacttggcaatactatatatctctttaagcctttcagaggatatgttttaggaggtggattgttccattttatatatatatgaacatgatagacagacagatagatagataaatagatagagataattttaaacgtgctcactttcatttatgaaaatttacatttgataactaaaagagccttgcaattccagcatctccctcatggtggcagtagaagactaagtcatgtacancgcagcctccagcaccaacaactaacccagaagaaacctccttaataaatcagcttttggtcaagattggtgttacgtaaaatgcaaaattaggaccctcggaaggggaaaaaaagagtctcaagtatctaggttattgaccccagaaacaaaagaaatttgacaaacttgcaaaacagagacaacaacttcctatgggggwaaaaaaaacaaagcaactacttgttgctgcccancccgtttagtaactggccttggtagtcttccagcagcaagcacaatagccttgtccacagnatgcttttcccatttcctcggtccccttgaaaccaagcttttgagaacaaatagttcatttctcctttcttaatttgctctgaaggtttttaacacagcgataactggcatatagaaatttcacatatttttcttgatcactatggcctatcaacccccgcctgatgattaaatgaaggacgatgtatccaaggttcttaaagaacttggttgcaacgaatgaacacaaaaaacaccagacaataaacatgtattgaattatnatctgggtacagtagacaccattgggcagacttcagaattagcccccggaagttttgcttttgcttgactcttggtcatagctgattggactagaagtgaacacctgactcaggaggaggaagttcattggctgaccaggag

SEQ ID NO: 211 - DNA, 1001 bp, Homo Sapiens
  allele 501: 12-495-424 : polymorphic base C or T
  misc_binding 481..500: 12-495-424.mis1, potential
  misc_binding 502..521: 12-495-424.mis2, potential complement
  primer_bind 78..97: upstream amplification primer
  primer_bind 526..544: downstream amplification primer, complement
  misc_binding 489..513: 12-495-424 potential probe
  misc_feature 147,383,444,707: n=a, g, c or t
tagacagacagatagatagataaatagatagagataattttaaacgtgctcactttcatttatgaaaatttacatttgataactaaaagagccttgcaattccagcatctccctcatggtggcagtagaagactaagtcatgtacancgcagcctccagcaccaacaactaacccagaagaaacctccttaataaatcagcttttggtcaagattggtgttacgtaaaatgcaaaattaggaccctcggaaggggaaaaaaagagtctcaagtatctaggttattgaccccagaaacaaaagaaatttgacaaacttgcaaaacagagacaacaacttcctatgggggtaaaaaaaacaaagcaactacttgttgctgcccancccgtttagtaactggccttggtagtcttccagcagcaagcacaatagccttgtccacagnatgcttttcccatttcctcggtccccttgaaaccaagcttttgagaacaaatagttyatttctcctttcttaatttgctctgaaggtttttaacacagcgataactggcatatagaaatttcacatatttttcttgatcactatggcctatcaacccccgcctgatgattaaatgaaggacgatgtatccaaggttcttaaagaacttggttgcaacgaatgaacacaaaaaacaccagacaataaacatgtattgaattatnatctgggtacagtagacaccattgggcagacttcagaattagcccccggaagttttgcttttgcttgactcttggtcatagctgattggactagaagtgaacacctgactcaggaggaggaagttcattggctgaccaggagccaattagggtctctctcttgagaactctgactaagagacagagatgcaggttatttagtccagttgcgggtgtagcattagacagatataaaacccaagaactcttggtactgaggcctggttgttcaactttcctcggattttagggggt

SEQ ID NO: 212 - DNA, 1001 bp, Homo Sapiens
  allele 501: 12-500-220 : polymorphic base A or G
  misc_binding 481..500: 12-500-220.mis1, potential
  misc_binding 502..521: 12-500-220.mis2, potential complement
  primer_bind 283..303: upstream amplification primer
  primer_bind 711..731: downstream amplification primer, complement
  misc_binding 489..513: 12-500-220 potential probe
tcccatctcttgaaaaaaaaaagcaactggaaagaattactattttttaaaaaatacttttaaaccttttttagagacagggtctcactatgttgctcaggctggtctcgaactcctgggctgaaatgatcgtcctcctgctgcctcagccttccaggtagctggaattacagacacaaaccaccatgctcagctttggaaagagttcttaaaggaattctaattagtggcctcagacaaattctagagaggttcagtcacatccataaaacaagtattatagattgtgcttatttaatggtgagtattctcaccagtagagcagatgttgaatatccaaggtagtgatttaaaagaccaaatgaagattaatcccagcaggatggtgaagaaatggaaattatggaaatcctgaagcatggaaagctctggaaaattcaatgtttgtgtaataatttagaagaggagaatagtttatataggaaagatatacaataatcraagaaataatagaatttttccttaataagtcttccttaaggatgagacaaatatttaactcaaatgtaggcatttattaatctcaaagagaaaattaactgtccggacaggagaaaaaattaggagacatgaaaaggggggaaaatcaactgatattacttttcatttgcaacattaaatgctagatggaaagaagttttcagaatctcgagaggtaaagaattaacaaccacagaattatcttctcagccaaattattctttaaatttcaggtgattctaacaaaactgaatggatcaagttagggctaaaagtatgccagaagtcttatctagtgtcttggtttgtttgggctgctgtaacaaaaataccttacagtgggtggcttataaacaacaggaatgtattgctcacagttctggaggctgggaagttcacgatcaagtcaccggcagtttcggtgtgtggtgagagcttttgctctctggttcatacatggt

SEQ ID NO: 213 - DNA, 1001 bp, Homo Sapiens
  allele 501: 12-501-155 : polymorphic base T or G
  misc_binding 481..500: 12-501-155.mis1, potential
  misc_binding 502..521: 12-501-155.mis2, potential complement
  primer_bind 636..655: upstream amplification primer, complement
  primer_bind 168..188: downstream amplification primer
  misc_binding 489..513: 12-501-155 potential probe
acagctctcatgagctttaccatctgaacacagctaagaatttgggattttaggaacagaactgtaaatcttaaaacaagcaaaaagtgctttctccttggtagaaatacctgtggccaagcccagaccttcagatcctaacttgggatacaactgattgttacttaacctgctgctaacctaaagactagttttctgctcatctagtcccctgtgtgaataagaggtttcctcctggtcccaggatgcctctgctgctcagctcatctctgaggctgtctgtgagccttcagttcagaaattgagggaaaatccattgccttggatgtctccttccaaatcaccacccaaaacaaaaattaggagacgtagaaatccaggatgtgttgtgggttaggccatattctgaggagttggaaggtttcttggggacctgaagtctcgtgaagagaaaatgtggaaataagtgtccttcaagccattgtagtgcttgacatgggkgaaagaggccagggggagggggacctgtggtgccagggcctttcagagcttggctagatgagggggtccttctcagaactgtaaataagctgctcagttgcatgattttcagaggccctgctaatgagctttttgtttgggttaagcctcccctgctttccctgaagataagccactgagttctatcagctgctgtcttctctccattatgctttcgtataaatatttaacatttcctataaacaattctggaagtacatgccaagtgatacttatggaagtgtaagaagatgtttcagttcaggctgctataactaccacagactgagtgacttacacaactgacatttgttactgttagggaggctggaagtgcaagagcaaggcactggcggattcagctcctggtgagcgctcttcatggtttgcagatggttgtcttgctgcgtcccatgtgttggagagatcatttctcttgtatctctccttatctaaggaca

SEQ ID NO: 214 - DNA, 998 bp, Homo Sapiens
  allele 501: 12-503-52 : polymorphic base T or G
  misc_binding 481..500: 12-503-52.mis1, potential
  misc_binding 502..521: 12-503-52.mis2, potential complement
  primer_bind 535..552: upstream amplification primer, complement
  primer_bind 80..100: downstream amplification primer
  misc_binding 489..513: 12-503-52 potential probe
  misc_feature 105,135,165,402,424,522,569,587,843,873: n=a, g, c or t
gaatcatgtattctgtcatttgatattacatcttttaatatttgataagtgtctttaatttgcatacaaaatgtcttgattccatttaatcttgatgcccatcanggtatccacgatgtaattcttagaacagancatataatattacatctgtctattgaattnctccaaaaaatgtatatatcctctgtacaatactaaaaatggttatcatatttctattcacagaagcaatgttttcatgtattaaactaagactatgagctgagtacttcacatgtttgacataatcatttttggtggaaataatggccacacatctttgtatacacaagccatatttgctctattatcatttcccaggcaattagcatttttatgtcaatattatctgtttccaanttcattaataatttcacgaggntagatcatatctagttttttctttcacatttcaataaagtcagtataacttttttctgttgatataacatcattctkaatgtgaacatacttaataantgttacatacttgttcacaatcggctacatctggtatataataaaanatcaaggtattttgcttnccttttttttaattgagacattcttgctctgtcgcccaggctggagtgcagtggtgtgttctcagctcactgcaacctccatctccagggtgcaagtgattcgcccacctcagcctcccgagtagctgggactacaggtgtgtgccaccacaccagctaatttttgtatttttagtagagaggggtttcaccacattggccatgctggtctcgaactcctgacgtcaagtgacccacccgcctccgactcccaaangtgctgggattacaggcatgagccactgcngccagcttgctcacatacttatttcaagcttttgaaatgtctaacatttccctttcttcacttttgtcttcacaattcaaaacagattctttagttaactctgaatttggtaattgttctattct

SEQ ID NO: 215 - DNA, 1001 bp, Homo Sapiens
  allele 501: 12-503-62 : polymorphic base T or A
  misc_binding 481..500: 12-503-62.mis1, potential
  misc_binding 502..521: 12-503-62.mis2, potential complement
  primer_bind 545..562: upstream amplification primer, complement
  primer_bind 90..110: downstream amplification primer
  misc_binding 489..513: 12-503-62 potential probe
  misc_feature 115,145,175,412,434,532,579,597,853,883: n=a, g, c or t
ttcaattatagaatcatgtattctgtcatttgatattacatcttttaatatttgataagtgtctttaatttgcatacaaaatgtcttgattccatttaatcttgatgcccatcanggtatccacgatgtaattcttagaacagancatataatattacatctgtctattgaattnctccaaaaaatgtatatatcctctgtacaatactaaaaatggttatcatatttctattcacagaagcaatgttttcatgtattaaactaagactatgagctgagtacttcacatgtttgacataatcatttttggtggaaataatggccacacatctttgtatacacaagccatatttgctctattatcatttcccaggcaattagcatttttatgtcaatattatctgtttccaanttcattaataatttcacgaggntagatcatatctagttttttctttcacatttcaataaagtcagtataacttttttctgttgatatawcatcattcttaatgtgaacatacttaataantgttacatacttgttcacaatcggctacatctggtatataataaaanatcaaggtattttgcttnccttttttttaattgagacattcttgctctgtcgcccaggctggagtgcagtggtgtgttctcagctcactgcaacctccatctccagggtgcaagtgattcgcccacctcagcctcccgagtagctgggactacaggtgtgtgccaccacaccagctaatttttgtatttttagtagagaggggtttcaccacattggccatgctggtctcgaactcctgacgtcaagtgacccacccgcctccgactcccaaangtgctgggattacaggcatgagccactgcngccagcttgctcacatacttatttcaagcttttgaaatgtctaacatttccctttcttcacttttgtcttcacaattcaaaacagattctttagttaactctgaatttggtaattgtt

SEQ ID NO: 216 - DNA, 1013 bp, Homo Sapiens
  allele 499: 12-504-54 : polymorphic base A or G
  misc_binding 479..498: 12-504-54.mis1, potential
  misc_binding 500..519: 12-504-54.mis2, potential complement
  primer_bind 446..463: upstream amplification primer
  primer_bind 993..1013: downstream amplification primer, complement
  misc_binding 487..511: 12-504-54 potential probe
  misc_feature 108,180..181,663,712,768: n=a, g, c or t
tgtttgagacagtctcactctgtcacccaggctagagtacagtggtgcaatctcagctcgctgcaaactccacctcccaggttcaagtgattctcctgcctcagcctncccgagtagctgggattacagatggccaccaccatgcccaactattttttgtatttttcgtagagacagggnntttcaccatgttggcctgagtggtcttgaactcctgacctcaagtgatctgcccacctcggcctcccaaagtgctggaattataggcatgagccatcgtgcccagcgtggttgtgcttattttaaattcttaatttgtttgttccagtatttctgcttgatatcgtgtatgttcagtgtgtgtttttctttttgcagtggttctaacctcaggtattttaagctgtgagctgatgttcccctggagttatcaggtaccaatgtgacataccaataccaggtcctactttctgtgttccttatggttttaagattaagragttgagtcccagagagtcccttaggtgttggaacgatagtcaacaagccatctgttgcccctccactaggcattactctgctagggattctcctctaaagcctttgaaagggagccggtagtcatctcataagtgatgcaccatttaccacacatgaggaggnactggaggagtgagtgctcagggaagctggtcagcctcccctttttagncgtgggtgattgctgctgcctcctgactcacagtggttatgggacaggcaatggtnccaaaggaaagaggagagaaaaggagagcagaacctagcagcactctacctattattctaactctgcattcctccccacccaaagtttatgatggcctttagtgtctccaggagtttctcacagtttttttctagggctgattccccagggcatctgtggcctgtgcctgatcttgtctgtacttcaggggccagcagtgggggataggttactgaaagtttttgagttttgctgtgagaagatt

SEQ ID NO: 217 - DNA, 1001 bp, Homo Sapiens
  allele 501: 12-504-96 : polymorphic base C or T
  misc_binding 481..500: 12-504-96.mis1, potential
  misc_binding 502..521: 12-504-96.mis2, potential complement
  primer_bind 406..423: upstream amplification primer
  primer_bind 953..973: downstream amplification primer, complement
  misc_binding 489..513: 12-504-96 potential probe
  misc_feature 68,140..141,623,672,728: n=a, g, c or t
agtggtgcaatctcagctcgctgcaaactccacctcccaggttcaagtgattctcctgcctcagcctncccgagtagctgggattacagatggccaccaccatgcccaactattttttgtatttttcgtagagacagggnntttcaccatgttggcctgagtggtcttgaactcctgacctcaagtgatctgcccacctcggcctcccaaagtgctggaattataggcatgagccatcgtgcccagcgtggttgtgcttattttaaattcttaatttgtttgttccagtatttctgcttgatatcgtgtatgttcagtgtgtgtttttctttttgcagtggttctaacctcaggtattttaagctgtgagctgatgttcccctggagttatcaggtaccaatgtgacataccaataccaggtcctactttctgtgttccttatggttttaagattaaggagttgagtcccagagagtcccttaggtgttggaacgatagtyaacaagccatctgttgcccctccactaggcattactctgctagggattctcctctaaagcctttgaaagggagccggtagtcatctcataagtgatgcaccatttaccacacatgaggaggnactggaggagtgagtgctcagggaagctggtcagcctcccctttttagncgtgggtgattgctgctgcctcctgactcacagtggttatgggacaggcaatggtnccaaaggaaagaggagagaaaaggagagcagaacctagcagcactctacctattattctaactctgcattcctccccacccaaagtttatgatggcctttagtgtctccaggagtttctcacagtttttttctagggctgattccccagggcatctgtggcctgtgcctgatcttgtctgtacttcaggggccagcagtgggggataggttactgaaagtttttgagttttgctgtgagaagattaatctttcagcagagtgcaataaaagga

SEQ ID NO: 218 - DNA, 1001 bp, Homo Sapiens
  allele 501: 12-504-428 : polymorphic base G or C
  misc_binding 482..500: 12-504-428.mis1
  misc_binding 502..521: 12-504-428.mis2, potential complement
  primer_bind 75..92: upstream amplification primer
  primer_bind 622..642: downstream amplification primer, complement
  misc_binding 489..513: 12-504-428 potential probe
  misc_feature 292,341,397: n=a, g, c or t
tttgcagtggttctaacctcaggtattttaagctgtgagctgatgttcccctggagttatcaggtaccaatgtgacataccaataccaggtcctactttctgtgttccttatggttttaagattaaggagttgagtcccagagagtcccttaggtgttggaacgatagtcaacaagccatctgttgcccctccactaggcattactctgctagggattctcctctaaagcctttgaaagggagccggtagtcatctcataagtgatgcaccatttaccacacatgaggaggnactggaggagtgagtgctcagggaagctggtcagcctcccctttttagncgtgggtgattgctgctgcctcctgactcacagtggttatgggacaggcaatggtnccaaaggaaagaggagagaaaaggagagcagaacctagcagcactctacctattattctaactctgcattcctccccacccaaagtttatgatggcctttagtstctccaggagtttctcacagtttttttctagggctgattccccagggcatctgtggcctgtgcctgatcttgtctgtacttcaggggccagcagtgggggataggttactgaaagtttttgagttttgctgtgagaagattaatctttcagcagagtgcaataaaaggaggaaggaaaccctgttactagtttaagtaagcaataatggagatctggattaatagtttgtatgttgaagtgagaagattttttttttaagtataaatgatttatttgttagttgagcccaagcttgaagaagctgctcttttattttgcctcttttttttcttacatatgtttattcttagccttttcttttcttttctttctttttttttttttttgcagtgaattctacaaactaagcactggaagaatgtcgagatgttacagtgaaaaaggaagctaaatgaggccagattggagagcaaattgttattatttaaaacttatggac

SEQ ID NO: 219 - DNA, 1001 bp, Homo Sapiens
  allele 474: 12-507-53 : polymorphic base C or T
  misc_binding 454..473: 12-507-53.mis1, potential
  misc_binding 475..493: 12-507-53.mis2, complement
  primer_bind 422..441: upstream amplification primer
  primer_bind 982..1001: downstream amplification primer, complement
  misc_binding 462..486: 12-507-53 potential probe
  misc_feature 153,560,925,934: n=a, g, c or t
agtgtagctactccccctgtgctcccacccccaccatataccagtggttcttaaactttaacatgcatcataatcacccagagagtttgttaaaacagggattgctgggctccacctccagagtttctgattcagtaaatctggggcaagccnttgataatgtgtttcctaacaagtccccaactcatagtgacactactagtccagggatcaactctgagaatcactgccatataccaatatttctcagtactgactgcacctggggattttaaagagaatacaactgccaaaaattaccagtgctcaggtctgttcccactgattctgatttaattggttgggaatgaggccaggatacctgtattttataaaagttcttcaggagattctaaggtatacttaggttcaagaagcacttccttacactcaatctccacccgtcattcagagaaactcatgtagtttctgttycaccttccattaaagccttcaatgttaagctattatcaagatatttttatatagactgggatgcctattagtcttagtcaccaccnaaaatgtaagtcactaagtatttatcctctcccttactcttactatttctccatgatttctctccactaatccatacctgctcctactttgccttccaccatgagtaaaagttccttgaggcctccccagaagcagacgccgccatgcttcctgtacagcctgcagagccatgagccaattaaaccacttttcttataaattacccagtctcaggtatttctttatggcaatgcaagaaaggactgatacaggtaataaatcattcattcattcaaataaagttaccatagtgttggggatacagaaaagagacagccccttaaggagctcaaagtcctcagaatacccttcctttattgtgatnttagtgccnacttttgaagacaaaaaagaagtaagagtcttatttcgtgaacatgtgcaaatgtatgactcattac

SEQ ID NO: 220 - DNA, 1001 bp, Homo Sapiens
  allele 501: 12-507-92 : polymorphic base A or G
  misc_binding 481..500: 12-507-92.mis1, potential
  misc_binding 502..521: 12-507-92.mis2, potential complement
  primer_bind 410..429: upstream amplification primer
  primer_bind 970..990: downstream amplification primer, complement
  misc_binding 489..513: 12-507-92 potential probe
  misc_feature 141,548,913,922: n=a, g, c or t
ccccctgtgctcccacccccaccatataccagtggttcttaaactttaacatgcatcataatcacccagagagtttgttaaaacagggattgctgggctccacctccagagtttctgattcagtaaatctggggcaagccnttgataatgtgtttcctaacaagtccccaactcatagtgacactactagtccagggatcaactctgagaatcactgccatataccaatatttctcagtactgactgcacctggggattttaaagagaatacaactgccaaaaattaccagtgctcaggtctgttcccactgattctgatttaattggttgggaatgaggccaggatacctgtattttataaaagttcttcaggagattctaaggtatacttaggttcaagaagcacttccttacactcaatctccacccgtcattcagagaaactcatgtagtttctgtttcaccttccattaaagccttcaatgttaagctattatcargatatttttatatagactgggatgcctattagtcttagtcaccaccnaaaatgtaagtcactaagtatttatcctctcccttactcttactatttctccatgatttctctccactaatccatacctgctcctactttgccttccaccatgagtaaaagttccttgaggcctccccagaagcagacgccgccatgcttcctgtacagcctgcagagccatgagccaattaaaccacttttcttataaattacccagtctcaggtatttctttatggcaatgcaagaaaggactgatacaggtaataaatcattcattcattcaaataaagttaccatagtgttggggatacagaaaagagacagccccttaaggagctcaaagtcctcagaatacccttcctttattgtgatnttagtgccnacttttgaagacaaaaaagaagtaagagtcttatttcgtgaacatgtggcaaatgtatgactcattacgtttatggttc

SEQ ID NO: 221 - DNA, 1000 bp, Homo Sapiens
  allele 500: 12-507-159 : polymorphic base G or T
  misc_binding 480..499: 12-507-159.mis1, potential
  misc_binding 501..520: 12-507-159.mis2, potential complement
  primer_bind 341..360: upstream amplification primer
  primer_bind 901..921: downstream amplification primer, complement
  misc_binding 488..512: 12-507-159 potential probe
  misc_feature 72,479,844,853: n=a, g, c or t
agagtttgttaaaacagggattgctgggctccacctccagagtttctgattcagtaaatctggggcaagccnttgataatgtgtttcctaacaagtccccaactcatagtgacactactagtccagggatcaactctgagaatcactgccatataccaatatttctcagtactgactgcacctggggattttaaagagaatacaactgccaaaaattaccagtgctcaggtctgttcccactgattctgatttaattggttgggaatgaggccaggatacctgtattttataaaagttcttcaggagattctaaggtatacttaggttcaagaagcacttccttacactcaatctccacccgtcattcagagaaactcatgtagtttctgtttcaccttccattaaagccttcaatgttaagctattatcaagatatttttatatagactgggatgcctattagtcttagtcaccaccnaaaatgtaagtcactaagtakttatcctctcccttactcttactatttctccatgatttctctccactaatccatacctgctcctactttgccttccaccatgagtaaaagttccttgaggcctccccagaagcagacgccgccatgcttcctgtacagcctgcagagccatgagccaattaaaccacttttcttataaattacccagtctcaggtatttctttatggcaatgcaagaaaggactgatacaggtaataaatcattcattcattcaaataaagttaccatagtgttggggatacagaaaagagacagccccttaaggagctcaaagtcctcagaatacccttcctttattgtgatnttagtgccnacttttgaagacaaaaaagaagtaagagtcttatttcgtgaacatgtggcaaatgtatgactcattacgtttatggttccactaagtttaaattaggaggaagttcctaataagtatttttaagcaaaaaatagttgtgatcgattg

SEQ ID NO: 222 - DNA, 1001 bp, Homo Sapiens
  allele 501: 12-507-177 : polymorphic base G or C
  misc_binding 481..500: 12-507-177.mis1, potential
  misc_binding 502..521: 12-507-177.mis2, potential complement
  primer_bind 324..343: upstream amplification primer
  primer_bind 884..904: downstream amplification primer, complement
  misc_binding 489..513: 12-507-177 potential probe
  misc_feature 55,462,827,836: n=a, g, c or t
ggattgctgggctccacctccagagtttctgattcagtaaatctggggcaagccnttgataatgtgtttcctaacaagtccccaactcatagtgacactactagtccagggatcaactctgagaatcactgccatataccaatatttctcagtactgactgcacctggggattttaaagagaatacaactgccaaaaattaccagtgctcaggtctgttcccactgattctgatttaattggttgggaatgaggccaggatacctgtattttataaaagttcttcaggagattctaaggtatacttaggttcaagaagcacttccttacactcaatctccacccgtcattcagagaaactcatgtagtttctgtttcaccttccattaaagccttcaatgttaagctattatcaagatatttttatatagactgggatgcctattagtcttagtcaccaccnaaaatgtaagtcactaagtatttatcctctcccttactsttactatttctccatgatttctctccactaatccatacctgctcctactttgccttccaccatgagtaaaagttccttgaggcctccccagaagcagacgccgccatgcttcctgtacagcctgcagagccatgagccaattaaaccacttttcttataaattacccagtctcaggtatttctttatggcaatgcaagaaaggactgatacaggtaataaatcattcattcattcaaataaagttaccatagtgttggggatacagaaaagagacagccccttaaggagctcaaagtcctcagaatacccttcctttattgtgatnttagtgccnacttttgaagacaaaaaagaagtaagagtcttatttcgtgaacatgtggcaaatgtatgactcattacgtttatggttccactaagtttaaattaggaggaagttcctaataagtatttttaagcaaaaaatagttgtgatcgattgtaaaattagacacaaatt

SEQ ID NO: 223 - DNA, 1001 bp, Homo Sapiens
  allele 501: 12-508-29 : polymorphic base A or G
  misc_binding 481..500: 12-508-29.mis1, potential
  misc_binding 502..521: 12-508-29.mis2, potential complement
  primer_bind 473..491: upstream amplification primer
  primer_bind 907..925: downstream amplification primer, complement
  misc_binding 489..513: 12-508-29 potential probe
  misc_feature 847: n=a, g, c or t
cctaattaagcattgtttttacctctaggagtagatattaagaaattagtatttcataaaatacccagccattcctcaaattgttttttttttttttttttgaggcggagtcttgctctgtcacccaggccagagtgcagtgccgcgatctcggctcactgcaagctctgcctcctgagttcacgccattctcctgcctcagcctccttagtagctgggactacaggcgcccgccagcatgcctagctaattttttgtatttttagtagagatggggcttcaccgtgttagccaggatggtcttgatctcctgaccttgtgatccgcccgcctcggcctcccaaagtgctgggattacaggcatgagccaccgtgccctgcctgccattcctcaaattctaagctccctgaaactcttacccttaaggtagagtatcaaaagtttttaaaagcaagaaaagaaaatttttatcttatgctagtggtaaatgccatttaaaracttaaatcctaaaagcttgtatttacccttaaacttcattgtcacaggtatttctctgtctgctgtatattcagcattgtactgagtacttacatcgcctcagttaaaattctttgtttttgttggcctaatttcagattaacataaaagtacctcacccttgtttaaacctgcattaaatgacttggattactgtgtctggagttttcctagcaacactatttcacacacaaagcaaagtacatactagccttttgtatgtgtctttgtccttggttcaacagctcagggatagtagtgtattaatgacttttattctggtcttttatatgtgtctttgtcctntgatttgacagctgagaatagtggtttttattctagtaggataaaatttagccttttagcactagaagtctaagagattttaattttcatttgtaaaaatagtgcacatttaaaatctgaatgtcttgcagagtggtcaggcatttttttattg

SEQ ID NO: 224 - DNA, 1001 bp, Homo Sapiens
  allele 501: 12-509-42 : polymorphic base A or G
  misc_binding 481..500: 12-509-42.mis1, potential
  misc_binding 502..521: 12-509-42.mis2, potential complement
  primer_bind 460..479: upstream amplification primer
  primer_bind 889..909: downstream amplification primer, complement
  misc_binding 489..513: 12-509-42 potential probe
  misc_feature 678,728,796,824: n=a, g, c or t
taaaataatttattggggctttagatgttttatattggaaaatcgttgtcttaatgtatcactttttattatcaccaatcatctcggttattgcgtcaaaccccatttcagctctagtttgacttttaaatatgcagttacgattcagaatgctcatatagacaggctctaatcggaaataaacataaatgtgttgaggtggtgggggtgtttaacaaaaagctaaaagtttgaagaacctctttgaggactagtgcagaaagatcaaggtgactgcagagaaggagcacttcagaaggcattacattttagtttgaaaaaccgtcaggaaattcttgaggcttccaactgatgattattctattgaaaagtaaatttggttttctttctcatttggtaaatattctgatgtttttctgtttcatttgcttaatgagatcatgaagtgattatactttaattgaggagagtttggtttgttaacattttaaatgtcatccrtttggcatttaaaactgatatttaaaactcagaatgagctttaactttttgttcttttgccctacccatgttttaaacttgtgggctaagagtgaatttgaaaactaaggatttcaatttttttcaaagttaggaaactaacaattaaagttattgcaacttagtttatataattgnctacaagttcttgctcatttggtaaaaaataaatgatgcactcagtaagncaaggaagtatctcttagactttctttaggaagcatgttttctagttaagcaaataacttaattccangtagcagatgccaggcagatgagttggnagtctaagtgagtgaaggaggaagtactgaagaaggaacatttcctcctagctgggagagttaggaatgctacacagagtaagtgggttccgtcctgggcctgagggatgggccagttcatctgttaaaatctatgactgtaactattgttacagcccagcttccatgatataatgt

SEQ ID NO: 225 - DNA, 1001 bp, Homo Sapiens
  allele 501: 12-509-126 : polymorphic base A or G
  misc_binding 481..500: 12-509-126.mis1, potential
  misc_binding 502..521: 12-509-126.mis2, potential complement
  primer_bind 376..395: upstream amplification primer
  primer_bind 805..825: downstream amplification primer, complement
  misc_binding 489..513: 12-509-126 potential probe
  misc_feature 594,644,712,740: n=a, g, c or t
cggttattgcgtcaaaccccatttcagctctagtttgacttttaaatatgcagttacgattcagaatgctcatatagacaggctctaatcggaaataaacataaatgtgttgaggtggtgggggtgtttaacaaaaagctaaaagtttgaagaacctctttgaggactagtgcagaaagatcaaggtgactgcagagaaggagcacttcagaaggcattacattttagtttgaaaaaccgtcaggaaattcttgaggcttccaactgatgattattctattgaaaagtaaatttggttttctttctcatttggtaaatattctgatgtttttctgtttcatttgcttaatgagatcatgaagtgattatactttaattgaggagagtttggtttgttaacattttaaatgtcatccgtttggcatttaaaactgatatttaaaactcagaatgagctttaactttttgttcttttgccctacccatgttttaaacttgtgrgctaagagtgaatttgaaaactaaggatttcaatttttttcaaagttaggaaactaacaattaaagttattgcaacttagtttatataattgnctacaagttcttgctcatttggtaaaaaataaatgatgcactcagtaagncaaggaagtatctcttagactttctttaggaagcatgttttctagttaagcaaataacttaattccangtagcagatgccaggcagatgagttggnagtctaagtgagtgaaggaggaagtactgaagaaggaacatttcctcctagctgggagagttaggaatgctacacagagtaagtgggttccgtcctgggcctgagggatgggccagttcatctgttaaaatctatgactgtaactattgttacagcccagcttccatgatataatgttaggaccccttccatgaaatgaaagcataatcaatttgagatagtttcatccagtattataacttttccctgcttcatataggt

SEQ ID NO: 226 - DNA, 1001 bp, Homo Sapiens
  allele 501: 12-510-59 : polymorphic base G or A
  misc_binding 481..500: 12-510-59.mis1, potential
  misc_binding 502..521: 12-510-59.mis2, potential complement
  primer_bind 539..559: upstream amplification primer, complement
  primer_bind 107..127: downstream amplification primer
  misc_binding 489..513: 12-510-59 potential probe
  misc_feature 7..8,169,196,281,468,470,821: n=a, g, c or t
tttgccnntcttctccactaccacctatcctcctatctctctcttctttctattacacacaatgaatgagtccctacctctgtgctgggcatcattctagaaataaaaaggtaagcaatgtagacagagatagtgaataaatacatattaataatgttttaaaactttnaaaaattgatataaactttcatatcancaaaatgtataaatcttaaatataaactcaatgaatcacttgagtgagcttaagtgtaagctcaaacaataacttaatagttttncataagtgctagaaatcttatccaggaataattgaaattttaccaatgagcataatatcccaaataaaataaatgggctttggtttgaattgtcattttgaagaccattactcagatatttgaaagttgttagtttggggcaaggtcatcacaccatggcctgtgggactaggggctaataatggtntnttatatttttgaaaggtttaagacaaaaacrgaagaagaaaaagaaggagaaagagaaggaacagagactatatgtggacttcaatgctgaaacatacttattatcttgtttcttatagaaaaatttgctaaccctggagctacagagtaaaagtcaactggaagccaagacagtgatttcttttctttgttctttagcctagtaagccagatgtgtcaacaggttctttttgactggcattaacatcttgctcaataataaaaggccttaaatttttactaacttatatcagccccacctagtgaaattaaatacaaggaatagttagctgaaacactgtgtaccagaanccattaagtcaggacagtctgaggttgttgacctcaattttgatatgaactggattttttagacacgtaggaatagttatggctatatttaactattttcatggctatggtgtatgtttttaagactttcccatagatattgtcattatctactggctggggcctttagaacagatggga

SEQ ID NO: 227 - DNA, 1001 bp, Homo Sapiens
  allele 501: 12-511-74 : polymorphic base T or C
  misc_binding 502..521: 12-511-74.mis1, potential complement
  misc_binding 483..500: 12-511-74.mis2
  primer_bind 558..575: upstream amplification primer, complement
  primer_bind 125..145: downstream amplification primer
  misc_binding 489..513: 12-511-74 potential probe
  misc_feature 102,561,637: n=a, g, c or t
tgcagccctgccctcagccaaggatctgtagggaactcccacttagacttctaggaactcatctttgcagctccctccttactggtaccatgccctgcaaanttccaaactttttgcatccctgaacttcagtctctgcctcttcagctcagggagactgctgtgctctgtttgggctccacttcatggcctctgttgttcaaaaagttgcccccaaacctggggcaaatgtgctgctcacttcataggcttcctttctctgaaggagcacagttctatgctgccttgcttccaacgtccgaaaatagctgtcatttattttgtcatttaaaaaccttgaattacagtaagggaaagcatattcataaatgaaatgatgtaaagactttaagtctacctaacatctagtttttttcttttttgctaattggactattcctcttttcattcatgtcctttaagtttgtttatggaaaaaaattatgacgaccacactcttcygtggttataggaactttcacacccattacaacattatgcatttatattctgacgaccttngatgggacacacaaaacctgattcttgcaactttgccatgaactttgtgatttccagagactggtaaccacttagnccccacaaacttctaattctctacacagattatctctctttccttgactcttatggtttgtaaataaatgtcttttacacacaactctgaagcgcgtcagattttatggtaccccatagggctataatgcctatagaaatgggaccaaattgaaattttggaaatctctcttggctttgtagactagttggtcgtaacttcccaagtcacacttctgatacacctgtgagggattactgctttgtgccacactagatgacctgcaaggttttctaaccatagataaagccagtctgtgattctcatggacaaattttatgtgtttgttggaaccaggcatccagaggttcctcattttgtctgt

SEQ ID NO: 228 - DNA, 1001 bp, Homo Sapiens
  allele 501: 10-325-311 : polymorphic base A or G
  misc_binding 481..500: 10-325-311.mis1, potential
  misc_binding 502..521: 10-325-311.mis2, potential complement
  primer_bind 191..208: upstream amplification primer
  primer_bind 596..613: downstream amplification primer, complement
  misc_binding 489..513: 10-325-311 potential probe
gcggaggggtcatcttcaccatctacaatgtgacaacaggtgggcccacatgtgaactgccatggggaagatgggcttgtccacaccactgcgtaaccccttctccagccagtcccatcaactcaagcccgtttctgggtgttcttgggccccctgccctgccccatttgcctcagctgtgcaaagcccttgtgtcaactcctgtccctgtgttagcccagagtccatctcataatgcagagatggaaactgaggcctagagcaggccaggggctgtctgcagggtccatgaccactcacctgccctgccctactccagggaaggtggaggtcatcaatgcccgggagacggtgccggccagccacgccccgagcctgctggaccagtgtgcacaggctctgccactgggcacaggtgacgccccatggaggtcccccactcccaccccccaggccactaggactaatcagaacacccccgcaaaggagcagcgcctcacrgacaggctgtgactccctggcacggggggacacggagcctgtggggaacccccagccccaacctgcagggattgagaaggtcccccttgggaacgggctctctgaggtgatccagggagagggaccaggctggacaaaggcctggagggttcagtggagatgggttggcggggcagggtggggctcctggggccagtttgtgtagggccccttgggcttggccatggactttgtggggagccacaggtgatttgagcagggagggacgtggtcgggtgtgggctccagaaagctcactctggctgctgtaactggggggccacatgtaggggtgatggcaaacctgggaaggcctggaagccacagggttgagagctgggatgtgccatgcaggggcccagtggatcggggtgcccggggagctccgtggctatgccgaggcccaccgccgccatggccgcctgccctgggcgcagctgttccagcccaccatcgcgctg

SEQ ID NO: 229 - DNA, 1001 bp, Homo Sapiens
  allele 501: 10-327-120 : polymorphic base C or T
  misc_binding 481..500: 10-327-120.mis1, potential
  misc_binding 502..521: 10-327-120.mis2, potential complement
  primer_bind 382..400: upstream amplification primer
  primer_bind 805..824: downstream amplification primer, complement
  misc_binding 489..513: 10-327-120 potential probe
ggccactaggactaatcagaacacccccgcaaaggagcagcgcctcacggacaggctgtgactccctggcacggggggacacggagcctgtggggaacccccagccccaacctgcagggattgagaaggtcccccttgggaacgggctctctgaggtgatccagggagagggaccaggctggacaaaggcctggagggttcagtggagatgggttggcggggcagggtggggctcctggggccagtttgtgtagggccccttgggcttggccatggactttgtggggagccacaggtgatttgagcagggagggacgtggtcgggtgtgggctccagaaagctcactctggctgctgtaactggggggccacatgtaggggtgatggcaaacctgggaaggcctggaagccacagggttgagagctgggatgtgccatgcaggggcccagtggatcggggtgcccggggagctccgtggctatgccgaggcccaccgccgycatggccgcctgccctgggcgcagctgttccagcccaccatcgcgctgctccgaggggggcatgtggtggcccctgtcctcagccgtttcctgcacaacagcatcctgcggccttccttgcaggcgtcaaccctgcggtgagccccacatggtggccctgggttcctgggttcaaggccatatcctgtctgggcccagtccacaccccagctctgcctcagtccctcttacactggaggattgaccctcggggtgctggccaggacaaagagtacttttcatggcccttccagctccccgtggcagagcctaacttggggttaggctgcggggagtttattgcccaagtgataggactccaaggtgtggatttgggctctgccacccgccctggggccccggcctccttcttcctctctctggcatggcaggagggcttcaactgccactctcacctgccccacccagcccactgacaggccctcccaggagtgagatga

SEQ ID NO: 230 - DNA, 1001 bp, Homo Sapiens
  allele 501: 10-331-179 : polymorphic base A or G
  misc_binding 481..500: 10-331-179.mis1, potential
  misc_binding 502..521: 10-331-179.mis2, potential complement
  primer_bind 326..345: upstream amplification primer
  primer_bind 728..747: downstream amplification primer, complement
  misc_binding 489..513: 10-331-179 potential probe
gccaggagttcaataccagcctgaacaacatggcgaaatcctgtctactaaaaatacaaaaataattagctgtacgtggtggcgaacacatgtagtctcagctactcaggagactaaggaccaagaatcacttgaacccaggaggcagagattgcagtgagctgagactgcgccattgcactccagcctgggcaatagagtgagactctgtctaaaaaaaaaaaaaaaaaaaaaaaaatccttaacttacttttccacttaaggtattagtcactcttgtgctgtataaggtaatatccacaggttttgggaattaggatgtgggtggatctttctgtggtggggggtgggggcaacattcaacccattacatagggtgaccccaaccaacctgtgccccaacctctctccagggttcaacttctcaacagagtctatggccaggcctgaagggagggtgaacgtgtaccaccaccttgtagagacgctcaagtttgccarggggcagaggtggaggctgggggaccctcgaagccacccgaagctccaggtgaggttgctgaggttgctgggctggtgggccgtcctcctccctggctcaggacttggcatgaaatgagggtcaggcctggtagggggaagttggagggatatgtatgtggttctaggccagggcaggactgaaagggatcccggggtggcaggtacaggggtcaggtgcaggagtggcaccatatctcaaaggacctggagggtgagcagagtctagacctagctgggcttgagggagacctggccacaaggtagaggacagactggaggtggcccccatgggggctgatctcatcctgcccttggttctgcggattctgcctggcccctcactgaccctgccacctgcccacccaccccagaatgcctcccgggacctgctgggggagaccctggcccagctcatccgccaacagatcgatggccggggggaccaccagctcagccac

SEQ ID NO: 231 - DNA, 1001 bp, Homo Sapiens
  allele 501: 10-331-357 : polymorphic base G or T
  misc_binding 481..500: 10-331-357.mis1, potential
  misc_binding 502..521: 10-331-357.mis2, potential complement
  primer_bind 148..167: upstream amplification primer
  primer_bind 550..569: downstream amplification primer, complement
  misc_binding 489..513: 10-331-357 potential probe
cactccagcctgggcaatagagtgagactctgtctaaaaaaaaaaaaaaaaaaaaaaaaatccttaacttacttttccacttaaggtattagtcactcttgtgctgtataaggtaatatccacaggttttgggaattaggatgtgggtggatctttctgtggtggggggtgggggcaacattcaacccattacatagggtgaccccaaccaacctgtgccccaacctctctccagggttcaacttctcaacagagtctatggccaggcctgaagggagggtgaacgtgtaccaccaccttgtagagacgctcaagtttgccaaggggcagaggtggaggctgggggaccctcgaagccacccgaagctccaggtgaggttgctgaggttgctgggctggtgggccgtcctcctccctggctcaggacttggcatgaaatgagggtcaggcctggtagggggaagttggagggatatgtatgtggttctaggccagggcagkactgaaagggatcccggggtggcaggtacaggggtcaggtgcaggagtggcaccatatctcaaaggacctggagggtgagcagagtctagacctagctgggcttgagggagacctggccacaaggtagaggacagactggaggtggcccccatgggggctgatctcatcctgcccttggttctgcggattctgcctggcccctcactgaccctgccacctgcccacccaccccagaatgcctcccgggacctgctgggggagaccctggcccagctcatccgccaacagatcgatggccggggggaccaccagctcagccactacagcttggccgaggcctggggccacgggacaggcacgtcccatgtgtctgtgctgggggaggatggcagcgccgtggctgccaccagcaccatcaacacaccgtgcgtagggcctgggggaaggcggatggcttcactcctcctctcctagacctgcacacccccagccccatgtc

SEQ ID NO: 232 - DNA, 1001 bp, Homo Sapiens
  allele 501: 10-334-263 : polymorphic base A or G
  misc_binding 481..500: 10-334-263.mis1, potential
  misc_binding 502..521: 10-334-263.mis2, potential complement
  primer_bind 240..257: upstream amplification primer
  primer_bind 658..675: downstream amplification primer, complement
  misc_binding 489..513: 10-334-263 potential probe
tgcacacccccagccccatgtcccctcacttgtccccacggggcagcaccttgcttttgccctttttctcctcctctatttcaaaagaggcccccacccctgacatctctggctggaaaggctgctgctggggtggccccgacccaagatttacctgggaatgggtagcctcactcagaagggtgccctgatgtgggggcacaggtgggtctttggggacccctcctgggtggtgccagggagagaatagcggcttcagcatgcttcggggcagctgtaaaacgagggggtcctgcaaagcgtgcagggtaagtggtgtctggtgggagccccgggtcctagcccaggctcttctgcctccacggctgcagctttggagcgatggtgtattcaccacggacaggcatcatcctcaacaacgagctcctggacttatgcgagcgatgcccccggggttccggcaccaccccctcacctggtgagaacaaagcttcccacccrgggtccacaagggccccccaccaggggagaggagggagggggctgggctggggttgcatgctaacccctggatgggtcactgcacttgccaagacgctgtttgctcagcagtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggtgagtctggggctcctggctcgagtgtctcctctctgggcagcatactgtctgactgtctctggagtggggatgtgagggctgatgtagggtagcagggtgccccctttctccctgaaaccctcatctctcccccaggccatcatgagcaagctgtggcttggctttgacctgagagcggccattgcagcccccatcctgcatgtcaacagcaagggctgt

SEQ ID NO: 233 - DNA, 1001 bp, Homo Sapiens
  allele 501: 10-321-226 : polymorphic base A or G
  misc_binding 481..500: 10-321-226.mis1, potential
  misc_binding 502..521: 10-321-226.mis2, potential complement
  primer_bind 276..293: upstream amplification primer
  primer_bind 692..711: downstream amplification primer, complement
  misc_binding 489..513: 10-321-226 potential probe
gcacaggtgggtctttggggacccctcctgggtggtgccagggagagaatagcggcttcagcatgcttcggggcagctgtaaaacgagggggtcctgcaaagcgtgcagggtaagtggtgtctggtgggagccccgggtcctagcccaggctcttctgcctccacggctgcagctttggagcgatggtgtattcaccacggacaggcatcatcctcaacaacgagctcctggacttatgcgagcgatgcccccggggttccggcaccaccccctcacctggtgagaacaaagcttcccacccagggtccacaagggccccccaccaggggagaggagggagggggctgggctggggttgcatgctaacccctggatgggtcactgcacttgccaagacgctgtttgctcagcagtgagtggagacagggtgggtggagctcccggaaggtgctggcccccagttccaggcgagcgttccccatcctccatggtgccctccrtcttgatcaacaaagcccaggggtcgaagctagtgattggcggggctggcggggagctcatcatctctgctgtggcccaggtgagtctggggctcctggctcgagtgtctcctctctgggcagcatactgtctgactgtctctggagtggggatgtgagggctgatgtagggtagcagggtgccccctttctccctgaaaccctcatctctcccccaggccatcatgagcaagctgtggcttggctttgacctgagagcggccattgcagcccccatcctgcatgtcaacagcaagggctgtgtggagtacgagcccaacttcagccaggtgaggctgaggtccgagctggatgcctagggcagagcccactccccaaatccgtgctgctcaaagccacctgggaggaactcagtcactgagattcttaggccaggtacacttcaactttgggggccataggagttggggaccttgatgggtgaggctgtcagtggcctc

SEQ ID NO: 234 - DNA, 858 bp, Homo Sapiens
  allele 501: 12-183-98 : polymorphic base G or A
  misc_binding 481..500: 12-183-98.mis1, potential
  misc_binding 502..521: 12-183-98.mis2, potential complement
  primer_bind 581..598: upstream amplification primer, complement
  primer_bind 136..155: downstream amplification primer
  misc_binding 489..513: 12-183-98 potential probe
ctgagaccccagagggtccctcccagcatcttcaaagcaacaggattttgtgcctgcagatccttctttgcagcacacaccacccaccctgaccaggacccctagaatgcccagcatccctgggagggccctgtggtagtttcagctccctctgggggcccagaatgaacctggcctgtggtgaggatgtaagcaccaatggccaattgggtccaaaggaagacaccggttcaaacactgaaaccaatcagattctcccacggccttcctgccatcagacgacactggtgcaggggtggttgctatgtacagggcagagccacccaatccccacgcaggagctgtgtcctgccatgctggcctcctcctggccatcacatcaggccaagcaggggagaggaatgggaatgcccatgcacccctatcaactctgcagacacagaaccatgcacagctcttgggaggagtcagatgagctgctcaaagcccgggagggacccrcacagtggtcagcatagcagggacggtgctttagccaaggcagggatggcaggtgactcactcaggatcttcaaggaggccgctgcatttccgtgctctttccagataagaaggacatgtcggtgatgatgagcgagacggacatgaacgccatcgcaggcacgctgaagctgtacttccgtgagctgcctgagcccctcttcactgacgagttctaccccagcttcgcagagggcatcggtgagcattggaggccttggcctcgtgggagacgtctcctccatgtgcactgctgcccttggaggctgtgaaaagtgaggtgtgggaacctgagctgtgacccctctgccatggtcg

SEQ ID NO: 235 - DNA, 1001 bp, Homo Sapiens
  allele 501: 12-185-78 : polymorphic base C or T
  misc_binding 481..500: 12-185-78.mis1, potential
  misc_binding 502..521: 12-185-78.mis2, potential complement
  primer_bind 424..444: upstream amplification primer
  primer_bind 855..875: downstream amplification primer, complement
  misc_binding 489..513: 12-185-78 potential probe
  misc_feature 661,672,954: n=a, g, c or t
gctgagaaagccacagttctggcagctggcagagctgaaagagaagggaaaatctatgcacagggcccttggatttccacccatattccccaggaaaggatacagttccaggaagggctctctctgatctcccggaatgaaatctgagatgaaccacagggccttattgcttacctgtacctcctttttgtagtttccagctggcctggcacagactgacaaccccaaatggatggtcgaaatccactgttctccagtccctctcaaacctcaccggcaagaaggaaagaaactaaaccccgagggcccattatattccagcggggtcctagggattccacactcattcagttcctttacatcataagaagtgggtattataatatcagatccactgtaaaaggtgatcccgaagcaaatggtagagcaggagtctgaataggggcacctccaacagccacatccaccccaccacagctcccaggggtttctttctaatcycaagggtggcctataccctgggactatagggggccttggtgtgctaaatcttcagagacatttttaaacggtcaagacgcctcttggcgactggaagaagttcctgacctcgcggcattccctccttcccatccccactaccacaccaatcctatgccangcctgtctgtngtcagggaagaagtccagctggacaactctggcagcctcctgtcgccctcccctgccagcaatccttctgtgccacagctgtgtgtccacactctaaagcacacatcccaccaggccactctcctgtaaaataatgcctcactgtcccaggccaaataccccagcgccgatacctgcttcttcaaatccaggctccaacccatccctccatctcatttccattttacgtgcacacatagtcacacactctcacatacccacactttggctcctactgttccntacccctgaaaaccccttaccactttcctccctgagaaataactgct

SEQ ID NO: 236 - DNA, 1001 bp, Homo Sapiens
  allele 501: 12-186-154 : polymorphic base A or G
  misc_binding 481..500: 12-186-154.mis1, potential
  misc_binding 502..520: 12-186-154.mis2, complement
  primer_bind 348..368: upstream amplification primer
  primer_bind 784..803: downstream amplification primer, complement
  misc_binding 489..513: 12-186-154 potential probe
  misc_feature 3: n=a, g, c or t
ttntttttcttttttttgagacggagtctcgctctgttgcccaggctggcgtgcagtggcacgatcttggctcactgcaagctctgcctcccgagttcacgccattcccctgcctcatcctcccgcctcatcctcccaagtagctgggactacaggcacccaccaccacgctcggctaattttttgtatttttagtagagacagggtttcaccgtgttagccaggatggtctcgatctcctgaccttgtgatccgcccgccttggcctcccaaagtgctgggattataggcgtgagccaccgcgcccggcccctcccttgactcttgactgaaggacctttgtctttgtgaacatcaattctcaggacctttcaccctggggacgtgaaatgctgagaatttgggagatgacagtctggggactgggattaatggaatccagtgacccacaaacctaaggttctcagctcccttggggagttggaatgtcagctattcagrtctagggctttccatggagtaaatcctaaactctgggttggagactttaagcctccaaggaccttcacagctaaggcccagggactagggcgaggagagtctttgatcctcagagtcttggagtttggccagtggactctgaggaatggagtctctgagcactgaaggtccaactttggcttcagcagtaaaggatcttggccttcaagtctaaggacagtgggcaattagtaggtcaggcatggggaactcatagccaaacgtgcagggctccaaagacctcatttgccctgtcagcagctcaggccatgtggcatcacccgatgcatctagatgtctccggaatctcaggccctgcagggtgaggttctcgggccattagttttttttgttttgttttgttttgtttttttggcttgttgttgttgagacaaagtttcactctgtcacccaggctggagtgcagtggcgcgatctcagcttattgcaacctccacctc

SEQ ID NO: 237 - DNA, 1001 bp, Homo Sapiens
  allele 501: 12-186-397 : polymorphic base C or T
  misc_binding 482..500: 12-186-397.mis1
  misc_binding 502..521: 12-186-397.mis2, potential complement
  primer_bind 105..125: upstream amplification primer
  primer_bind 541..560: downstream amplification primer, complement
  misc_binding 489..513: 12-186-397 potential probe
ccttgtgatccgcccgccttggcctcccaaagtgctgggattataggcgtgagccaccgcgcccggcccctcccttgactcttgactgaaggacctttgtctttgtgaacatcaattctcaggacctttcaccctggggacgtgaaatgctgagaatttgggagatgacagtctggggactgggattaatggaatccagtgacccacaaacctaaggttctcagctcccttggggagttggaatgtcagctattcaggtctagggctttccatggagtaaatcctaaactctgggttggagactttaagcctccaaggaccttcacagctaaggcccagggactagggcgaggagagtctttgatcctcagagtcttggagtttggccagtggactctgaggaatggagtctctgagcactgaaggtccaactttggcttcagcagtaaaggatcttggccttcaagtctaaggacagtgggcaattagtaggtcaggcayggggaactcatagccaaacgtgcagggctccaaagacctcatttgccctgtcagcagctcaggccatgtggcatcacccgatgcatctagatgtctccggaatctcaggccctgcagggtgaggttctcgggccattagttttttttgttttgttttgttttgtttttttggcttgttgttgttgagacaaagtttcactctgtcacccaggctggagtgcagtggcgcgatctcagcttattgcaacctccacctcctgggttcaagcaattctcatgtctcagcctcccaagtagctgggattacaagtgtgtgccaccaagcctggctaatttttgtatttttagcagaaacagcgtttctccatgttggccaggctggtctcaaactcctgacctcaggtgatctgcccaccttggcctcccaaagtgctgggattacaggcatgaccaccgcgcctggctagggagcagtgtttttaaggacaacttggcgggtt

SEQ ID NO: 238 - DNA, 1001 bp, Homo Sapiens
  allele 501: 12-187-65 : polymorphic base C or T
  misc_binding 482..500: 12-187-65.mis1
  misc_binding 502..521: 12-187-65.mis2, potential complement
  primer_bind 437..456: upstream amplification primer
  primer_bind 839..859: downstream amplification primer, complement
  misc_binding 489..513: 12-187-65 potential probe
cctatatttttatttatttatttatttatttttctgagatggagtctcactctgtcacctaggctggagtgcagtggtgcaatcttggctcactgcaacctccgcctcccaggttcaagggattcttgtgcctcagcctcccgagtaaatgggattacaagcacccgccactgcatctggctaatttttgtatttttagtagagacaaggtttcaccacgttggccaggctggtctcgaactcctaacctcaaatgatctgccggcctcagcttcccaaagtgctgggattacaggtgtgagccaccgtgcccggccggcatcctatatttttatattctaactctggcaaccttaaatataagtgacaaatgaaaccaaaaataatgggcaaaggtctaaacacatcagtgatcataaaaaggaattgagaacattgtcagaacactgtcctgccttaaacactcttctggaaagttccacaggttaagtgtgtcgtgtygtcaggacctgagatctcttctgccaattaagctcccacaccatagaataaggaggaaaatttgcacatctgctttatgaagccagcgtagcactgaccccaaacttggcaaagaaaaccgcagactaattgtgtttatgatgcaaagcaaaatcctaacaaaattggagaatatataattaaaaaagagaatccagtagtacattaaaaagaacaacatgacttacctaccctagtggagccaacgctaatattgcaaggaagatcttctcagtatgtccctgaccgtgactcttagctcttacctttcaccagaggagaaaaaaatcactccatcgagactgaagacgcatttgacaatatttaacacccattcttttttttttttttttttaaagacaggtctcactctgttgcccatgctggagtggagtggtgcgatcacagctcactgcagccttgacctcctaggctcaagagatcctcctgcctcagctttt

SEQ ID NO: 239 - DNA, 1001 bp, Homo Sapiens
  allele 501: 12-187-66 : polymorphic base A or G
  misc_binding 481..500: 12-187-66.mis1, potential
  misc_binding 502..521: 12-187-66.mis2, potential complement
  primer_bind 436..455: upstream amplification primer
  primer_bind 838..858: downstream amplification primer, complement
  misc_binding 489..513: 12-187-66 potential probe
ctatatttttatttatttatttatttatttttctgagatggagtctcactctgtcacctaggctggagtgcagtggtgcaatcttggctcactgcaacctccgcctcccaggttcaagggattcttgtgcctcagcctcccgagtaaatgggattacaagcacccgccactgcatctggctaatttttgtatttttagtagagacaaggtttcaccacgttggccaggctggtctcgaactcctaacctcaaatgatctgccggcctcagcttcccaaagtgctgggattacaggtgtgagccaccgtgcccggccggcatcctatatttttatattctaactctggcaaccttaaatataagtgacaaatgaaaccaaaaataatgggcaaaggtctaaacacatcagtgatcataaaaaggaattgagaacattgtcagaacactgtcctgccttaaacactcttctggaaagttccacaggttaagtgtgtcgtgttrtcaggacctgagatctcttctgccaattaagctcccacaccatagaataaggaggaaaatttgcacatctgctttatgaagccagcgtagcactgaccccaaacttggcaaagaaaaccgcagactaattgtgtttatgatgcaaagcaaaatcctaacaaaattggagaatatataattaaaaaagagaatccagtagtacattaaaaagaacaacatgacttacctaccctagtggagccaacgctaatattgcaaggaagatcttctcagtatgtccctgaccgtgactcttagctcttacctttcaccagaggagaaaaaaatcactccatcgagactgaagacgcatttgacaatatttaacacccattcttttttttttttttttttaaagacaggtctcactctgttgcccatgctggagtggagtggtgcgatcacagctcactgcagccttgacctcctaggctcaagagatcctcctgcctcagcttttg

SEQ ID NO: 240 - DNA, 1001 bp, Homo Sapiens
  allele 501: 12-189-348 : polymorphic base G or A
  misc_binding 502..520: 12-189-348.mis1, complement
  misc_binding 481..500: 12-189-348.mis2, potential
  primer_bind 832..849: upstream amplification primer, complement
  primer_bind 384..402: downstream amplification primer
  misc_binding 489..513: 12-189-348 potential probe
  misc_feature 69,615: n=a, g, c or t
cgaggcaggtggatcaagtgaggtcagaagtttgagaccagcctagccaacatggtgaaaccctgtctnctaccaaaaatataaaaaattagctgggtgtggtggtgcgtgcctgtaatcccagctaattgggaggctgaggcagaagaatcgcttgaacccgggaggcagaggttgcaatgagccgatatcgtgccgctgcactccagcctgggcaacaaagtgagactccatctcaaaaaaaaaaaaaaaggactaggacaaaaatacctactttcaaggagttcacagtctacaggaataaacaggacatgtaaatgaacaaaataggtccccatcctttatgaacctactttaaaaaacaaaaaacagggcaagtatatgtacaggatacaatggaagcagaaagatccccaattctgccttactttgggcaacaaagtaggaggtacacctcgaaggtatgagagtaaacacaggttcaactgaagaactctaatracttggctagaatacagtatggctagaatacagaaatgtcaaaatgaggacttgtcggcaagggccagaagaccagtcaagccctgggcttcatgtgacacaggacggtgaatnaaaagccgtgcagtcctataacctgacttgcagttcccaaagactaacctgcgctgctgtactgaagatacagaatgggagggtcagggatgaggaaaacagaatgggcatctaattccctgtaatgtctttgctctcccttaatctaagctttatgttcaaaataaaagtaccactctcactccacaactcccccagtatctgaagaccaccatggcgattccctaaattggccctccttccaagtcagcaccacacattccccatccactcctccagatttcagtaccctgtgtccactggcatcaaagtatgacaggcacctcggaagtgggcacagatacaagacagatctggtctggcaagcacagagctcagcaagacta

SEQ ID NO: 241 - DNA, 1001 bp, Homo Sapiens
  allele 501: 12-192-63 : polymorphic base C or G
  misc_binding 481..500: 12-192-63.mis1, potential
  misc_binding 502..521: 12-192-63.mis2, potential complement
  primer_bind 544..563: upstream amplification primer, complement
  primer_bind 75..94: downstream amplification primer
  misc_binding 489..513: 12-192-63 potential probe
caagtttcccctgctgccacgcaggcgaggggagcctttgatgctgccacctcccttagagctggggtaccgggtcactgttgaagacctggaccgggagaaggaggcggccttccagcgcatcaacagtgcactgcaggttgaggacaaggccatctcggactgcagaccctcacggccttcccacactttgtcctcacttgcaacaggggcttctggtctgcctgccgtttctaaagcacccagtatggatgcacagcaggagacacacaagtcccaagactgcctgggcctactggaccccttagcatctgctgcaggggtcccctctacagctcccatgtctgggaagaagcacagaccaccaggccccctgttctcctcctcagatccccttcctgccacctcttctgattcccaggactcagcccaggtcacctcgctgattcctgcccccttcccagctgcaagcatggatgcgggcatgagaagaacaaggcstggcacttctgctcctgcagctgccgcagcagcccctccccgctccacattgaaccccacgttggggtcactactggagtggatggaggcccttcacatttctgggcctcagccacagctgcagcaggtgcccagaggtcagaaccagagatcccagacctcctggaccagctcgtgccccaaatgaaatgccatctcgagcccctacagctctacgggaggcctcccggaacaaaagcggaagaggggccagcctcatcccactgccagctgaccctcagttcctcaaacacagtgagtgaggacggacctcaggctgtctcttcgggtcacacccagtgtgaaaagacggcagatacagcaccagggcagacactcgcctccaggggtggctcccccagatcccaggcctctaggccccgtatatgcaagtttcccctgctgccacgcaggcgaggggagcctttgatgctgccacctcccttagagatggggtaccg

SEQ ID NO: 242 - DNA, 1001 bp, Homo Sapiens
  allele 502: 12-192-64 : polymorphic base T or C
  misc_binding 482..501: 12-192-64.mis1, potential
  misc_binding 503..522: 12-192-64.mis2, potential complement
  primer_bind 545..564: upstream amplification primer, complement
  primer_bind 76..95: downstream amplification primer
  misc_binding 490..514: 12-192-64 potential probe
acaagtttcccctgctgccacgcaggcgaggggagcctttgatgctgccacctcccttagagctggggtaccgggtcactgttgaagacctggaccgggagaaggaggcggccttccagcgcatcaacagtgcactgcaggttgaggacaaggccatctcggactgcagaccctcacggccttcccacactttgtcctcacttgcaacaggggcttctggtctgcctgccgtttctaaagcacccagtatggatgcacagcaggagacacacaagtcccaagactgcctgggcctactggaccccttagcatctgctgcaggggtcccctctacagctcccatgtctgggaagaagcacagaccaccaggccccctgttctcctcctcagatccccttcctgccacctcttctgattcccaggactcagcccaggtcacctcgctgattcctgcccccttcccagctgcaagcatggatgcgggcatgagaagaacaaggcytggcacttctgctcctgcagctgccgcagcagcccctccccgctccacattgaaccccacgttggggtcactactggagtggatggaggcccttcacatttctgggcctcagccacagctgcagcaggtgcccagaggtcagaaccagagatcccagacctcctggaccagctcgtgccccaaatgaaatgccatctcgagcccctacagctctacgggaggcctcccggaacaaaagcggaagaggggccagcctcatcccactgccagctgaccctcagttcctcaaacacagtgagtgaggacggacctcaggctgtctcttcgggtcacacccagtgtgaaaagacggcagatacagcaccagggcagacactcgcctccaggggtggctcccccagatcccaggcctctaggccccgtatatgcaagtttcccctgctgccacgcaggcgaggggagcctttgatgctgccacctcccttagagatggggtacc

SEQ ID NO: 243 - DNA, 1001 bp, Homo Sapiens
  allele 501: 12-192-268 : polymorphic base C or G
  misc_binding 481..500: 12-192-268.mis1, potential
  misc_binding 502..521: 12-192-268.mis2, potential complement
  primer_bind 749..768: upstream amplification primer, complement
  primer_bind 280..299: downstream amplification primer
  misc_binding 489..513: 12-192-268 potential probe
tgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcaccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggccttccagcgcatcaacagtgcactgcaggttgaggacaaggccatctcggactgcagaccctcacggccttcccacactttgtcctcacttgcaacaggggcttctggtctgcctgccgtttctaaagcacccagtatggatgcacagcaggagacacacaagtcccaagactgcctgggcctastggaccccttagcatctgctgcaggggtcccctctacagctcccatgtctgggaagaagcacagaccaccaggccccctgttctcctcctcagatccccttcctgccacctcttctgattcccaggactcagcccaggtcacctcgctgattcctgcccccttcccagctgcaagcatggatgcgggcatgagaagaacaaggcatggcacttctgctcctgcagctgccgcagcagcccctccccgctccacattgaaccccacgttggggtcactactggagtggatggaggcccttcacatttctgggcctcagccacagctgcagcaggtgcccagaggtcagaaccagagatcccagacctcctggaccagctcgtgccccaaatgaaatgccatctcgagcccctacagctctacgggaggcctcccggaacaaaagcggaagaggggccagcctcatcccactgccagctgaccctcagttcctcaaacacag

SEQ ID NO: 244 - DNA, 1001 bp, Homo Sapiens
  allele 501: 12-192-334 : polymorphic base G or A
  misc_binding 481..500: 12-192-334.mis1, potential
  misc_binding 502..521: 12-192-334.mis2, potential complement
  primer_bind 815..834: upstream amplification primer, complement
  primer_bind 346..365: downstream amplification primer
  misc_binding 489..513: 12-192-334 potential probe
cctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcaccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggccttccagcgcatcaacagtgcactgcaggttgaggacaaggccatctcggactgcagaccctcacggccttcccacactttgtcctcacttgcaacaggggcttctggtctgcctgccrtttctaaagcacccagtatggatgcacagcaggagacacacaagtcccaagactgcctgggcctactggaccccttagcatctgctgcaggggtcccctctacagctcccatgtctgggaagaagcacagaccaccaggccccctgttctcctcctcagatccccttcctgccacctcttctgattcccaggactcagcccaggtcacctcgctgattcctgcccccttcccagctgcaagcatggatgcgggcatgagaagaacaaggcatggcacttctgctcctgcagctgccgcagcagcccctccccgctccacattgaaccccacgttggggtcactactggagtggatggaggcccttcacatttctgggcctcagccacagctgcagcaggtgcccagaggtcagaaccagagatcccagacctcctggaccagctcgtgccccaaatgaaatgccatctcgagcccctacagctctacgggaggcctcccg

SEQ ID NO: 245 - DNA, 1001 bp, Homo Sapiens
  allele 501: 12-192-352 : polymorphic base G or A
  misc_binding 481..500: 12-192-352.mis1, potential
  misc_binding 502..521: 12-192-352.mis2, potential complement
  primer_bind 833..852: upstream amplification primer, complement
  primer_bind 364..383: downstream amplification primer
  misc_binding 489..513: 12-192-352 potential probe
ataacccgacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcaccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggccttccagcgcatcaacagtgcactgcaggttgaggacaaggccatctcggactgcagaccctcacggccttcccacactttgtcctcacttgcaacagggrcttctggtctgcctgccgtttctaaagcacccagtatggatgcacagcaggagacacacaagtcccaagactgcctgggcctactggaccccttagcatctgctgcaggggtcccctctacagctcccatgtctgggaagaagcacagaccaccaggccccctgttctcctcctcagatccccttcctgccacctcttctgattcccaggactcagcccaggtcacctcgctgattcctgcccccttcccagctgcaagcatggatgcgggcatgagaagaacaaggcatggcacttctgctcctgcagctgccgcagcagcccctccccgctccacattgaaccccacgttggggtcactactggagtggatggaggcccttcacatttctgggcctcagccacagctgcagcaggtgcccagaggtcagaaccagagatcccagacctcctggaccagctcgtgccccaaatgaaatgccatctcgagcccctacagc

SEQ ID NO: 246 - DNA, 1001 bp, Homo Sapiens
  allele 501: 12-194-135 : polymorphic base G or T
  misc_binding 481..500: 12-194-135.mis1, potential
  misc_binding 502..521: 12-194-135.mis2, potential complement
  primer_bind 363..381: upstream amplification primer
  primer_bind 878..893: downstream amplification primer, complement
  misc_binding 489..513: 12-194-135 potential probe
  misc_feature 223,412,431,439..440,565..566,894: n=a, g, c or t
gcgggtggatcacctgaggttaggagttcgataccagcctggccaacatggtgaaaccccgtctctacaaaaaatataaaaattagtcgggcgtggtggcacacgcttgtgatcccagcggctcgggaggccgagacaggagaattgcttaggaggcagagggtgcagtgaaccgaggtctcgccactgcactccagcctgggcgacagagtgagactctgtnctcaaaaaaaaaaaaaaacagctattacaatatacatgtatgttgtaaaataaccaaaccaacatagaagggtatatagtgaaaggagaagtattgttgtgggtaaaattgtttcaataaatggctaatccagtatttttttcctccaaaaaaacaccttttcccctttgatttagtgtataccacacnagagtcgcttagccgattncagtgacnnttttttgatagctggagaatgcttcctaatggttgcaggtgtgtaggggttttcttgacaktttcagtaagaaagtgaatgttgtgccataggaaagctttatcacaggtgcacgttggtagccnnaactaaataacgtgagtgtcaagtacagtatctagtgagtggagaataactgtaataattacaattacagttgtagttaaagtgaagtttgtatcaaaatttctgtttcaaaggtgaacttttaggaggtgtatctgcggtgtttcttcctcagatgtgatttctctgaagcagtggttctctataactgacttgacacacagtgcatctgatatttcgaatgacttaagtgatagtatcaaaattactatcatatacatatttaaatcacatgactaacctgtgtgtggtattatgcaaactgctcagctcagtaagggaacagaanataagaaaaaaaggacaatattgggagtcttttatacaattcaatttattcaattgaaggactatcttttctttaaaaaagttctgctttcttggtgttaaaataaa

SEQ ID NO: 247 - DNA, 1001 bp, Homo Sapiens
  allele 501: 12-194-325 : polymorphic base A or G
  misc_binding 481..500: 12-194-325.mis1, potential
  misc_binding 502..521: 12-194-325.mis2, potential complement
  primer_bind 171..189: upstream amplification primer
  primer_bind 686..707: downstream amplification primer, complement
  misc_binding 489..513: 12-194-325 potential probe
  misc_feature 31,220,239,247..248,373..374,702: n=a, g, c or t
tccagcctgggcgacagagtgagactctgtnctcaaaaaaaaaaaaaaacagctattacaatatacatgtatgttgtaaaataaccaaaccaacatagaagggtatatagtgaaaggagaagtattgttgtgggtaaaattgtttcaataaatggctaatccagtatttttttcctccaaaaaaacaccttttcccctttgatttagtgtataccacacnagagtcgcttagccgattncagtgacnnttttttgatagctggagaatgcttcctaatggttgcaggtgtgtaggggttttcttgacattttcagtaagaaagtgaatgttgtgccataggaaagctttatcacaggtgcacgttggtagccnnaactaaataacgtgagtgtcaagtacagtatctagtgagtggagaataactgtaataattacaattacagttgtagttaaagtgaagtttgtatcaaaatttctgtttcaaaggtgaacttttaggrggtgtatctgcggtgtttcttcctcagatgtgatttctctgaagcagtggttctctataactgacttgacacacagtgcatctgatatttcgaatgacttaagtgatagtatcaaaattactatcatatacatatttaaatcacatgactaacctgtgtgtggtattatgcaaactgctcagctcagtaagggaacagaanataagaaaaaaaggacaatattgggagtcttttatacaattcaatttattcaattgaaggactatcttttctttaaaaaagttctgctttcttggtgttaaaataaagcatcttttatgaaatgatggtgatagtaaatggtgatatatggtaaacgtaaatagtaaatgcaagggtagttattgtgatttttaaaaataaagagagccgagaatctcttgttttcctgctgctgttagggagttcaggaaaaagttcctggggcttttgctgttaagaagattcaaatatagagtatt

SEQ ID NO: 248 - DNA, 1001 bp, Homo Sapiens
  allele 501: 12-194-337 : polymorphic base A or G
  misc_binding 481..500: 12-194-337.mis1, potential
  misc_binding 502..521: 12-194-337.mis2, potential complement
  primer_bind 159..177: upstream amplification primer
  primer_bind 674..695: downstream amplification primer, complement
  misc_binding 489..513: 12-194-337 potential probe
  misc_feature 19,208,227,235..236,361..362,690: n=a, g, c or t
gacagagtgagactctgtnctcaaaaaaaaaaaaaaacagctattacaatatacatgtatgttgtaaaataaccaaaccaacatagaagggtatatagtgaaaggagaagtattgttgtgggtaaaattgtttcaataaatggctaatccagtatttttttcctccaaaaaaacaccttttcccctttgatttagtgtataccacacnagagtcgcttagccgattncagtgacnnttttttgatagctggagaatgcttcctaatggttgcaggtgtgtaggggttttcttgacattttcagtaagaaagtgaatgttgtgccataggaaagctttatcacaggtgcacgttggtagccnnaactaaataacgtgagtgtcaagtacagtatctagtgagtggagaataactgtaataattacaattacagttgtagttaaagtgaagtttgtatcaaaatttctgtttcaaaggtgaacttttaggaggtgtatctgcrgtgtttcttcctcagatgtgatttctctgaagcagtggttctctataactgacttgacacacagtgcatctgatatttcgaatgacttaagtgatagtatcaaaattactatcatatacatatttaaatcacatgactaacctgtgtgtggtattatgcaaactgctcagctcagtaagggaacagaanataagaaaaaaaggacaatattgggagtcttttatacaattcaatttattcaattgaaggactatcttttctttaaaaaagttctgctttcttggtgttaaaataaagcatcttttatgaaatgatggtgatagtaaatggtgatatatggtaaacgtaaatagtaaatgcaagggtagttattgtgatttttaaaaataaagagagccgagaatctcttgttttcctgctgctgttagggagttcaggaaaaagttcctggggcttttgctgttaagaagattcaaatatagagtatttcttaagagtaa

SEQ ID NO: 249 - DNA, 1001 bp, Homo Sapiens
  allele 501: 12-194-479 : polymorphic base C or T
  misc_binding 481..500: 12-194-479.mis1, potential
  misc_binding 502..521: 12-194-479.mis2, potential complement
  primer_bind 17..35: upstream amplification primer
  primer_bind 532..553: downstream amplification primer, complement
  misc_binding 489..513: 12-194-479 potential probe
  misc_feature 66,85,93..94,219..220,548: n=a, g, c or t
gctaatccagtatttttttcctccaaaaaaacaccttttcccctttgatttagtgtataccacacnagagtcgcttagccgattncagtgacnnttttttgatagctggagaatgcttcctaatggttgcaggtgtgtaggggttttcttgacattttcagtaagaaagtgaatgttgtgccataggaaagctttatcacaggtgcacgttggtagccnnaactaaataacgtgagtgtcaagtacagtatctagtgagtggagaataactgtaataattacaattacagttgtagttaaagtgaagtttgtatcaaaatttctgtttcaaaggtgaacttttaggaggtgtatctgcggtgtttcttcctcagatgtgatttctctgaagcagtggttctctataactgacttgacacacagtgcatctgatatttcgaatgacttaagtgatagtatcaaaattactatcatatacatatttaaatcacatgactaacytgtgtgtggtattatgcaaactgctcagctcagtaagggaacagaanataagaaaaaaaggacaatattgggagtcttttatacaattcaatttattcaattgaaggactatcttttctttaaaaaagttctgctttcttggtgttaaaataaagcatcttttatgaaatgatggtgatagtaaatggtgatatatggtaaacgtaaatagtaaatgcaagggtagttattgtgatttttaaaaataaagagagccgagaatctcttgttttcctgctgctgttagggagttcaggaaaaagttcctggggcttttgctgttaagaagattcaaatatagagtatttcttaagagtaaatatgagtttattttgagatcattggtcacagtctactgagaaatccactgagaaagctgttaaatttgcatggcattaaagatgttcctattctgatcattgttaaatagatcttttttattagatataattgtttttgag

SEQ ID NO: 250 - DNA, 1001 bp, Homo Sapiens
  allele 501: 10-442-133 : polymorphic base G or C
  misc_binding 482..500: 10-442-133.mis1
  misc_binding 502..521: 10-442-133.mis2, potential complement
  primer_bind 369..386: upstream amplification primer
  primer_bind 777..794: downstream amplification primer, complement
  misc_binding 489..513: 10-442-133 potential probe
ggcagagttgggaaatgcagcctgcacaggtgtgttcaggtggccggtgatatgtcacccccgcggcctagacttcagtcctgcatctgtcgtgaggagtaggaagtggggagagcagcccagaggccaggagctcggaagcccccaggtcccagtggccgccctgactgcctggcctctccccggcaaactccaggcacaatgacctcccctggcagctgctggatatgttcaacaaccggctgcaggacgagagggccaacctgaccaccttggccggcacacacaccaacatccccaagctgagggccggctttgtgggaggccaggtaccgcctgccctgccttgtgcttgccctgtgtggggtcatcccgtctcctacctcaggcctggctacagtgggaccatccctgtggtgttcctccagggtccctcggtgcccaggccgagggagggcttcccagcgggtgggaaaccagactcccacaggcatgcggggsgtgggctgagacctggctgcatcagctcctggcaccccctgcggcccacagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggtggggtcctgacctgggtcctccaggtcctgcgtcttctcacccagccctcatcctgagcagcaggtgccggtcaggacacctcaccctccagataccaggtgcccactcccctgcaccctgactctccccgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctggtgcgtgactccccatgggaggcccccgg

SEQ ID NO: 251 - DNA, 984 bp, Homo Sapiens
  allele 484: 10-444-248 : polymorphic base A or G
  misc_binding 464..483: 10-444-248.mis1, potential
  misc_binding 485..503: 10-444-248.mis2, complement
  primer_bind 237..253: upstream amplification primer
  primer_bind 567..586: downstream amplification primer, complement
  misc_binding 472..496: 10-444-248 potential probe
gcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctggtgcgtgactccccatgggaggcccccgggctgtggtcaggagggagggggcagacactccctgccaccctccagagcccatcccctctgcctgtgagtcccaggccgggcctcgcctgctgggctgatgggaggccgagaccaccgctcacctcttgggcacctgccttttgcttctccagggctgacaactggctggtggacacgggagacagcgagccccagagccaaggcttgtcaccctttgggcaggtgagtggggtgggagcggccagtcacccccgaggagaaggcagaggccctggagggtgaccagaacaatgcatctcctcrcgtgggacctcagtgtccttgtctgtaaaatggagctggcagccatccccccagggtgggtgctgagccctgagtggccccggacttccagccacgaaggatgatgactcacatctggtccagcccgtccacctccgcagccccgaccctgggggctgtgagggtggacggagccctgtcttcccagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtggtgagggccgagggggcgacctccaccccgcctccctgggcaggccctcccagctctcagcttcaccctgtcttccttcttgtgcagaaacagacagacagcctggtgatggtgaacttctacaacaattacattt

SEQ ID NO: 252 - DNA, 1001 bp, Homo Sapiens
  allele 501: 10-445-281 : polymorphic base C or T
  misc_binding 482..500: 10-445-281.mis1
  misc_binding 502..521: 10-445-281.mis2, potential complement
  primer_bind 221..238: upstream amplification primer
  primer_bind 624..641: downstream amplification primer, complement
  misc_binding 489..513: 10-445-281 potential probe
  misc_feature 926,936,957,960,972: n=a, g, c or t
cgggagacagcgagccccagagccaaggcttgtcaccctttgggcaggtgagtggggtgggagcggccagtcacccccgaggagaaggcagaggccctggagggtgaccagaacaatgcatctcctcgcgtgggacctcagtgtccttgtctgtaaaatggagctggcagccatccccccagggtgggtgctgagccctgagtggccccggacttccagccacgaaggatgatgactcacatctggtccagcccgtccacctccgcagccccgaccctgggggctgtgagggtggacggagccctgtcttcccagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtggtgagggcygagggggcgacctccaccccgcctccctgggcaggccctcccagctctcagcttcaccctgtcttccttcttgtgcagaaacagacagacagcctggtgatggtgaacttctacaacaattacatttcctgcaccaacaaggccaacctgtcccaagtggccggtaggtggggtgtgagcggccaagggggccgaagggggagggcctcactcgggacccatacctgctgctccctggacagaccatctggatcacatcaaggaggtggcaggagccagagccgtgggttttggtggggactttgatggtgttccaaggtaaggggctgagagctctgtcctgtggatgagccgggaggttcatggcctcgtcagagggatgaggtggctggaggagggacctgtgtcctagtgtgggggcccangttctcctgncctcaacacagggtccctganggnctggaggacgtntccaagtatccagacctgatcgctgagct

SEQ ID NO: 253 - DNA, 1001 bp, Homo Sapiens
  allele 501: 12-668-362 : polymorphic base T or A
  misc_binding 481..500: 12-668-362.mis1, potential
  misc_binding 502..521: 12-668-362.mis2, potential complement
  primer_bind 844..861: upstream amplification primer, complement
  primer_bind 390..410: downstream amplification primer
  misc_binding 489..513: 12-668-362 potential probe
cctgcgcctctcgtgcacctccacatctggtttgaggtcaggtcatttcctgtctgtgggcccagctgctgtgacacccaaggggagggccggcgtccccgaagccaggtcagccgtgcacccggcagagccccgcagattggccccagcagagcttggggtggggggagctcggtgtcaccaacaggcccttgaggacactcgtgtggagaatccctgggacacgtggaggacccccaagtcctgagccccgtactccgtactgcagggagcaggccaggagccacgggccttggggcacagggtccttctcagggacaggttcaggcactggctggaacaggctggacccctctacccagcacatgtgggcatgcgtctgggttccgagggtggggaaatgtggaaaggctcctgctggccggcttaggcctgctgcccttggagccttccatatacagagagtcccacctccagcaagggttggcctggactctccawccccctgctgtgcccaggactcccccagggacaaggcaaccagaggcccagacccctccccagcaaagagaagcaccacgggagctgtctcccaagagcccttgacctggggcccagctggcctagggccgggccccggggctgttgtagagcagagtgtccatctgtgcacgctgtagccacaagcgccgctgggcgtcgccaagcagcacacgcagcgagtggcctggacggcaggcgggcagggctgcacagtgggcagcatgcagctggcgacaggtgtcgcagcagagggtgggcagggcgccaggggacaggcagctgtgtgcctggtagcctgggggctccgagacagacctataggctgaggctggtaccccctctgcccgaatacgcctcgggctggccgctgcagagctttcaggggtggccaggtccccaggcctactcagctcacggcgcagagagaggaaggagaaggcggaaggttcaggttccag

SEQ ID NO: 254 - DNA, 1001 bp, Homo Sapiens
  allele 501: 12-670-48 : polymorphic base G or C
  misc_binding 481..500: 12-670-48.mis1, potential
  misc_binding 502..521: 12-670-48.mis2, potential complement
  primer_bind 454..474: upstream amplification primer
  primer_bind 883..901: downstream amplification primer, complement
  misc_binding 489..513: 12-670-48 potential probe
  misc_feature 49,105,142,317: n=a, g, c or t
cttttctggacattccatggaaagggaactgcaacatgagtggtctttncctctggcttgtctcactcagtgtcccacctttgggactccttcacggtgtggcangggagtcagcagcctgctcctcactgtcgctcagccngtcactgcatggagagcgtgcacacttcattttatctgctgaaactctgttctcactcttgctctgctgttttcccttcatgtccaccttcctcccccaccctctggtgtgacagacactgctggggcccttccaacaggcggtcctccttcccccacttccgttactggcagangtcctgcccactcccatgcttcacagctccctccagcccctggtgaatttgcaccattgaatgagtcctgcagaggctgggcaggcgaagccttcctgggaaaggtttccttgctaatatgaagcaaggagcaatgcctttgcagtagatgcagtcctgcctgcgtgtggggggctgtacactsatcgggggctgtggacactgagagtggtcaagaagagacacgcaaagtctttgatgtcactgttgtgctaacaagccaacctggaagctccacctctgacccttcattcgtgagacattaaatccctgtgttaaagctgcgtttagtgagcttttctgtaactttcagctaaaagcaccgtgacagacaggtagcattttccaaactgccacccaagggtgatgctattcctgcagggttccatcctccggtggggggttgcgccctcctgtgaggggttccaccctccagtgggaggttccaaagttgggaattcaaatccaagtctttcttccaagtccaaggcccagagcctcctactttcagcccttgatcctacaagcgtgtcagtgtgaagcagtccaggcccagctcctctgcctagcaggccagtcatccccctgacattctttcttgtctgacccgagtggttctctccttattatttttttttttttctg

SEQ ID NO: 255 - DNA, 1001 bp, Homo Sapiens
  allele 501: 12-670-91 : polymorphic base C or T
  misc_binding 481..500: 12-670-91.mis1, potential
  misc_binding 502..521: 12-670-91.mis2, potential complement
  primer_bind 411..431: upstream amplification primer
  primer_bind 840..858: downstream amplification primer, complement
  misc_binding 489..513: 12-670-91 potential probe
  misc_feature 6,62,99,274: n=a, g, c or t
tctttncctctggcttgtctcactcagtgtcccacctttgggactccttcacggtgtggcangggagtcagcagcctgctcctcactgtcgctcagccngtcactgcatggagagcgtgcacacttcattttatctgctgaaactctgttctcactcttgctctgctgttttcccttcatgtccaccttcctcccccaccctctggtgtgacagacactgctggggcccttccaacaggcggtcctccttcccccacttccgttactggcagangtcctgcccactcccatgcttcacagctccctccagcccctggtgaatttgcaccattgaatgagtcctgcagaggctgggcaggcgaagccttcctgggaaaggtttccttgctaatatgaagcaaggagcaatgcctttgcagtagatgcagtcctgcctgcgtgtggggggctgtacactcatcgggggctgtggacactgagagtggtcaagaagagacacgyaaagtctttgatgtcactgttgtgctaacaagccaacctggaagctccacctctgacccttcattcgtgagacattaaatccctgtgttaaagctgcgtttagtgagcttttctgtaactttcagctaaaagcaccgtgacagacaggtagcattttccaaactgccacccaagggtgatgctattcctgcagggttccatcctccggtggggggttgcgccctcctgtgaggggttccaccctccagtgggaggttccaaagttgggaattcaaatccaagtctttcttccaagtccaaggcccagagcctcctactttcagcccttgatcctacaagcgtgtcagtgtgaagcagtccaggcccagctcctctgcctagcaggccagtcatccccctgacattctttcttgtctgacccgagtggttctctccttattatttttttttttttctgagacagagtctcactctgtagcccaggctggagtgcagtggtg

SEQ ID NO: 256 - DNA, 1001 bp, Homo Sapiens
  allele 501: 12-670-157 : polymorphic base C or T
  misc_binding 482..500: 12-670-157.mis1
  misc_binding 502..521: 12-670-157.mis2, potential complement
  primer_bind 345..365: upstream amplification primer
  primer_bind 774..792: downstream amplification primer, complement
  misc_binding 489..513: 12-670-157 potential probe
  misc_feature 33,208: n=a, g, c or t
gtcagcagcctgctcctcactgtcgctcagccngtcactgcatggagagcgtgcacacttcattttatctgctgaaactctgttctcactcttgctctgctgttttcccttcatgtccaccttcctcccccaccctctggtgtgacagacactgctggggcccttccaacaggcggtcctccttcccccacttccgttactggcagangtcctgcccactcccatgcttcacagctccctccagcccctggtgaatttgcaccattgaatgagtcctgcagaggctgggcaggcgaagccttcctgggaaaggtttccttgctaatatgaagcaaggagcaatgcctttgcagtagatgcagtcctgcctgcgtgtggggggctgtacactcatcgggggctgtggacactgagagtggtcaagaagagacacgcaaagtctttgatgtcactgttgtgctaacaagccaacctggaagctccacctctgacccttcattygtgagacattaaatccctgtgttaaagctgcgtttagtgagcttttctgtaactttcagctaaaagcaccgtgacagacaggtagcattttccaaactgccacccaagggtgatgctattcctgcagggttccatcctccggtggggggttgcgccctcctgtgaggggttccaccctccagtgggaggttccaaagttgggaattcaaatccaagtctttcttccaagtccaaggcccagagcctcctactttcagcccttgatcctacaagcgtgtcagtgtgaagcagtccaggcccagctcctctgcctagcaggccagtcatccccctgacattctttcttgtctgacccgagtggttctctccttattatttttttttttttctgagacagagtctcactctgtagcccaggctggagtgcagtggtgcgatctcgctcaccgctacttctgcctcccgggtcccggttcaaggttcgagcaattctcctgcct

SEQ ID NO: 257 - DNA, 1001 bp, Homo Sapiens
  allele 501: 12-671-148 : polymorphic base C or T
  misc_binding 482..500: 12-671-148.mis1
  misc_binding 502..521: 12-671-148.mis2, potential complement
  primer_bind 354..372: upstream amplification primer
  primer_bind 784..804: downstream amplification primer, complement
  misc_binding 489..513: 12-671-148 potential probe
  misc_feature 31,33,37,88,270,348,764: n=a, g, c or t
agcggcctccctcagctggtgtcggagtgcncngccntggaggagttcatccacgaggggtagaccctggcgggtcagggtgggggtnctctgtgcgaagagcagggacctcatccctcaacctaaacggtggttgtcagtagcagctggggagggtagcgtgtggctccgtcacagccatgccttcgggcagcccctgtgggtccacctgtgcagagtgcctgctgccacatgtcccgtggcccttcgcttagctcagcctctcccagnacagcaggagctgggggctgtcccctgagcagcatctgcctggggaggggataaggatccagtgccatccctggctcntaccgtccaaggacgagcacatagtgggtgggaaaggcctcctctagcccagccgccctgacagccccacctgcccaccctcagcacccaggtcctgaactgggagggcagacactaccttctggagggccgggggtgtccttctgttcgttyagatgacaccggctgcccctgccatccatgcaggtacctgatcggagaggagggctactgcctcacatcactgcagagtgccctgagctacgtggagctgctgccccggggaggcctggccaagtagtacagctagagcccagggtccctgcagggcctggcctcgcctcccagggctgtctctcctacacctggagccatgggatctactgaggaccatcctggagcctcacgctgctctgcacatggtgggggcttgtccnactgtggtgtgctctccagctcttcaccttcctcacctcacatctgaccctggagcttggggttggcacctctgccccgacagaatggggctgaatcagctccaggaggaaccaggccctgctctcctgtgtaggcctcagagaggccaagaagggaagctttgggcttcggtgggtgcaggctcagcgatgaacatctggctggggcagctcctggggagcatcagggaagagggg

SEQ ID NO: 258 - DNA, 1001 bp, Homo Sapiens
  allele 253: 12-679-245 : polymorphic base A or G
  misc_binding 233..252: 12-679-245.mis1, potential
  misc_binding 254..273: 12-679-245.mis2, potential complement
  primer_bind 9..29: upstream amplification primer
  primer_bind 439..458: downstream amplification primer, complement
  misc_binding 241..265: 12-679-245 potential probe
  misc_feature 257..258,678,798: n=a, g, c or t
tgcccacttacttcctttctgggtaaggctcaaaggactcgtccgaagactgggcattttgcttcttgtcattttcatcttcactcaagacgtctctaggaattaagagagaatcttcagcaaagccctgggcctgggcagtgacagacccaacacgacctcctgcctaaagataccaaatggacccccatgtcccacatttgagttcttctgaaaatgtcttaaatctaaaatccccaaatttccaatcccrtttnncgaacacaaagggccagccaggctcacaagccagcaatccccacaagccatgtgctctgggcaccaggacactggacttggaaacagccctttccacagcggcccagaaggggtggaggcgctcaaaggtagcttcctgctaagcagactttgagaaatcgaccacctcaccccataactgcgaaccctatgcaactgatgggtttgccatgagtcacttctaagttcacaaaagtggctgggtgcagaggctaactcctgtaatcccagcacttcgggaggctgacgtaggtggatcgcatgaggtcaggagttcaagaccagcctggccaataccgtgaaaccccgtctctactaaaaatacaaaaattggccgggtgcggtggctcacacctgtaatcccagcactttgggaggcangaggcgggcggatcacgaggtcaggagatcaagaccatcccggctaacaaagtgaaaccccgtctctactaaaaatacaaaaaattagccgggcgtggtggcgggtgcctgtagtcccangcgactcagaagctgaggccggagaatggcgtgaacccgggaggcagagcttgcagtaggccgagattgtgccactgcactccagcctgggcaacacagcgagactccgtctcaaataaaaaaaaaataaataaatacaaaacttagctgggtgtggtggcgggcgcctgtaatcccagctactcgggaggctgaggcgggag

SEQ ID NO: 259 - DNA, 1001 bp, Homo Sapiens
  allele 379: 12-679-371 : polymorphic base A or G
  misc_binding 359..378: 12-679-371.mis1, potential
  misc_binding 380..399: 12-679-371.mis2, potential complement
  primer_bind 9..29: upstream amplification primer
  primer_bind 439..458: downstream amplification primer, complement
  misc_binding 367..391: 12-679-371 potential probe
  misc_feature 257..258,678,798: n=a, g, c or t
tgcccacttacttcctttctgggtaaggctcaaaggactcgtccgaagactgggcattttgcttcttgtcattttcatcttcactcaagacgtctctaggaattaagagagaatcttcagcaaagccctgggcctgggcagtgacagacccaacacgacctcctgcctaaagataccaaatggacccccatgtcccacatttgagttcttctgaaaatgtcttaaatctaaaatccccaaatttccaatcccatttnncgaacacaaagggccagccaggctcacaagccagcaatccccacaagccatgtgctctgggcaccaggacactggacttggaaacagccctttccacagcggcccagaaggggtggaggcrctcaaaggtagcttcctgctaagcagactttgagaaatcgaccacctcaccccataactgcgaaccctatgcaactgatgggtttgccatgagtcacttctaagttcacaaaagtggctgggtgcagaggctaactcctgtaatcccagcacttcgggaggctgacgtaggtggatcgcatgaggtcaggagttcaagaccagcctggccaataccgtgaaaccccgtctctactaaaaatacaaaaattggccgggtgcggtggctcacacctgtaatcccagcactttgggaggcangaggcgggcggatcacgaggtcaggagatcaagaccatcccggctaacaaagtgaaaccccgtctctactaaaaatacaaaaaattagccgggcgtggtggcgggtgcctgtagtcccangcgactcagaagctgaggccggagaatggcgtgaacccgggaggcagagcttgcagtaggccgagattgtgccactgcactccagcctgggcaacacagcgagactccgtctcaaataaaaaaaaaataaataaatacaaaacttagctgggtgtggtggcgggcgcctgtaatcccagctactcgggaggctgaggcgggag

SEQ ID NO: 260 - DNA, 1001 bp, Homo Sapiens
  allele 434: 12-679-426 : polymorphic base C or T
  misc_binding 414..433: 12-679-426.mis1, potential
  misc_binding 435..454: 12-679-426.mis2, potential complement
  primer_bind 9..29: upstream amplification primer
  primer_bind 439..458: downstream amplification primer, complement
  misc_binding 422..446: 12-679-426 potential probe
  misc_feature 257..258,678,798: n=a, g, c or t
tgcccacttacttcctttctgggtaaggctcaaaggactcgtccgaagactgggcattttgcttcttgtcattttcatcttcactcaagacgtctctaggaattaagagagaatcttcagcaaagccctgggcctgggcagtgacagacccaacacgacctcctgcctaaagataccaaatggacccccatgtcccacatttgagttcttctgaaaatgtcttaaatctaaaatccccaaatttccaatcccatttnncgaacacaaagggccagccaggctcacaagccagcaatccccacaagccatgtgctctgggcaccaggacactggacttggaaacagccctttccacagcggcccagaaggggtggaggcgctcaaaggtagcttcctgctaagcagactttgagaaatcgaccacctcaccccayaactgcgaaccctatgcaactgatgggtttgccatgagtcacttctaagttcacaaaagtggctgggtgcagaggctaactcctgtaatcccagcacttcgggaggctgacgtaggtggatcgcatgaggtcaggagttcaagaccagcctggccaataccgtgaaaccccgtctctactaaaaatacaaaaattggccgggtgcggtggctcacacctgtaatcccagcactttgggaggcangaggcgggcggatcacgaggtcaggagatcaagaccatcccggctaacaaagtgaaaccccgtctctactaaaaatacaaaaaattagccgggcgtggtggcgggtgcctgtagtcccangcgactcagaagctgaggccggagaatggcgtgaacccgggaggcagagcttgcagtaggccgagattgtgccactgcactccagcctgggcaacacagcgagactccgtctcaaataaaaaaaaaataaataaatacaaaacttagctgggtgtggtggcgggcgcctgtaatcccagctactcgggaggctgaggcgggag

SEQ ID NO: 261 - DNA, 1001 bp, Homo Sapiens
  allele 503: 12-680-331 : polymorphic base C or T
  misc_binding 483..502: 12-680-331.mis1, potential
  misc_binding 504..523: 12-680-331.mis2, potential complement
  primer_bind 173..192: upstream amplification primer
  primer_bind 645..665: downstream amplification primer, complement
  misc_binding 491..515: 12-680-331 potential probe
ggtaagaggatcctctaggtggggggggggggttccccaggtgaggggacctccaggtaagaggatcctctaggtgggggagtcccccaggtgaagggccctccaggtaagagggtcctccaggtgagagggtcctccagcggagggggtcccccaggtaagagggtcctccagttgggagtccttcaggtggggtggtcctccaggtgagagagtcttccaggtgagagggtcctccaggtgagaggtgaaggtgaaggtcctccaggtgagggtcaggtcacttggtccagggatgtggcttcagcaagcatttgggtgcctcctctgtgttcaggacatggggactccgggagactgaaggaagcaagtggcaatgtccatgccgtcaagttctgtcacagaaataagcaggagtgagtgaaagacaggagagaagctctgtgaggggtggcattcaagcttagcttctgggcaggaagaggcagctatgtcagcattcyctaacaaggtttggcaaagtagatacctcccctcactcatggaagacctgacttcccaggctggtagaagcttctctcacaggcacctgcctctccaatctctttcacagcccagccctggaaggtggaaaaagaaaagttgacatggaatgtttaggaagcaccattggtccaggtccaggatcggggcagccagcatgtcctctaatctggcttcactgttgaaatccagtcgagcaagcagggcccaaaccactgcgagaccagctcggtcgggcccaaaccaccgcccactgcgggaccagctcggtcgggcccaaaccaccgcccactgcgggaccagctcggtcgggcccaaaccactgcccactgcgggaccagctcggtcgtggagaccctaacccagcggcgctagaggaattaaagaaacacacacagaaatatagggtgtggagtgggaaatcaggggtctcacagccttcgaagctgaaagcctcg

SEQ ID NO: 262 - DNA, 384 bp, Homo Sapiens
  allele 154: 10-151-154 : polymorphic base A or G
  misc_binding 134..153: 10-151-154.mis1, potential
  misc_binding 155..173: 10-151-154.mis2, complement
  primer_bind 1..18: upstream amplification primer
  primer_bind 367..384: downstream amplification primer, complement
  misc_binding 142..166: 10-151-154 potential probe
  misc_feature 346..347: n=a, g, c or t
actcaamacccaaggagcccattctctcccttggctttctctcaggtcaaggtgttgaaatgcatctcagaggtgcaggccaacaatgtggtcctgggccagtacgtggggaaccccgatggagagggcgaggccaccaaagggtacctggacraccccacggtgccccgcgggtccaccaccgccacttttgcagccgtcgtcctctatgtggagaatgagaggtgggatggtaggtgatgccttcgaggcccagcaaggcagaactgggcatgccctgtgtgcgggcactggagctcccactgagacactcacgcactggtccacaccctgagagagctggtgnngaggctgccctttccgccacgtaggggtgcccttcat

SEQ ID NO: 263 - DNA, 426 bp, Homo Sapiens
  allele 205: 10-138-206 : polymorphic base C or T
  misc_binding 186..204: 10-138-206.mis1
  misc_binding 206..225: 10-138-206.mis2, potential complement
  primer_bind 1..18: upstream amplification primer
  primer_bind 406..425: downstream amplification primer, complement
  misc_binding 193..217: 10-138-206 potential probe
  misc_feature 243: n=a, g, c or t
atgatgmccaagaagccgggcatgttcttcaaccccgaggagtcggagctggacctgactacggcaacagatacaaggtgccctacagagaaggagcagtgtggagggtgggcggcctgggcccgggggactccacatggtggcaggcagtggcatcagcaagacactctctccctcacagaacgtgaagctccctgacgcctaygagcgcctcatcctggacgtcttctgcgggagccagangcacttcgtgcgcaggtgaggcccagctgccggcccctgcatacctgtgggctatggggtggcctttgccctccctccctgtgtgccaccggcctcccaagccatactatgtcccctcagcgacgagctccgtgaggcctggcgtattttcaccccactgctgcaccagattgagctggagag

SEQ ID NO: 264 - DNA, 426 bp, Homo Sapiens
  allele 351: 10-138-352 : polymorphic base C or T
  misc_binding 332..350: 10-138-352.mis1
  misc_binding 352..371: 10-138-352.mis2, potential complement
  primer_bind 1..18: upstream amplification primer
  primer_bind 406..425: downstream amplification primer, complement
  misc_binding 339..363: 10-138-352 potential probe
  misc_feature 243: n=a, g, c or t
atgatgmccaagaagccgggcatgttcttcaaccccgaggagtcggagctggacctgactacggcaacagatacaaggtgccctacagagaaggagcagtgtggagggtgggcggcctgggcccgggggactccacatggtggcaggcagtggcatcagcaagacactctctccctcacagaacgtgaagctccctgacgcctacgagcgcctcatcctggacgtcttctgcgggagccagangcacttcgtgcgcaggtgaggcccagctgccggcccctgcatacctgtgggctatggggtggcctttgccctccctccctgtgtgccaccggcctcccaagccatacyatgtcccctcagcgacgagctccgtgaggcctggcgtattttcaccccactgctgcaccagattgagctggagag

SEQ ID NO: 265 - DNA, 1001 bp, Homo Sapiens
  allele 501: 12-586-414 : polymorphic base A or G
  misc_binding 482..500: 12-586-414.mis1
  misc_binding 502..521: 12-586-414.mis2, potential complement
  primer_bind 88..107: upstream amplification primer
  primer_bind 552..572: downstream amplification primer, complement
  misc_binding 489..513: 12-586-414 potential probe
gtggtcagctatcccaaggctcctggctgttgacattttatgttcagcttgcacttctctttctcttctttagtgcctgcaacttctcacccacactttcaacagagaattcagccaggtgcacggcagcgtcagtgactgtaaggtgagcacattgactgtaatttttagccagtatgttgataactgatttctccacagcagcccagattacctattcctggtttttgctgcttttaagcaacttgtcatgggcatagcattgtatttgaaaatttatgacatactgctctggtattcattctaatttttcagagtccgaacactgacttctgaagataaaagtactcctttgtgtctcttagagtgattatcagatgggaaacattttggctttttcatgactcctttggaggagaatattctatggggaggtggtatgttattctttgccagggtacaaggaaaccctgaggttcctggtggcataaagttttattracttcaacaaagagtgaagtaaacacttcagagaatttctgtgttattcactcaattctagtcagcttgaccttaaaccctcccggctcattcctgccttggggtctttgcacacctactatttctttgcctggaattgcctttctccaggtattgccatggttggctcccttacctctttcatttttctactccattatcacctcctgtgagtcgactctgttaacacctgataataaatctgacagctgtctgaaactttctacctacccctctttcctgctttattttttgctatagcactaattactacctgatgctttttaaagtgtttgttgagtggtttattgtctgtcttaagctccagggaggcagatcctctgccatattattagaacaatgcctagtacatggaaggtgcaccactgtaataccacttatattaattcaggggctgggtgtggtggtgcatacctgtaatcccagcactttgggaggcc

SEQ ID NO: 266 - DNA, 999 bp, Homo Sapiens
  allele 499: 12-587-379 : polymorphic base C or A
  misc_binding 479..498: 12-587-379.mis1, potential
  misc_binding 500..519: 12-587-379.mis2, potential complement
  primer_bind 857..877: upstream amplification primer, complement
  primer_bind 478..498: downstream amplification primer
  misc_binding 487..511: 12-587-379 potential probe
cagcacttttctagctctcccgttccccatctccattgctctgtactcttttcttttttcttgtgctgagaatctcgttagtagcatgtggcctaacaaaaggaaaaaatgtttttaaacacacacacacacacacacacacacacacacatacacagacaaaaacacaaaaactctgaggggatctggtgaatctccaaattattgtgggtgtactttggcttccttttgtatgataggtccccatcatgaccacctctgatgtctgtgctgctgtcaccaggcacctttgtttttcaagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagmactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcag

SEQ ID NO: 267 - DNA, 1001 bp, Homo Sapiens
  allele 501: 12-588-103 : polymorphic base G or A
  misc_binding 502..521: 12-588-103.mis1, potential complement
  misc_binding 482..500: 12-588-103.mis2
  primer_bind 585..603: upstream amplification primer, complement
  primer_bind 60..77: downstream amplification primer
  misc_binding 489..513: 12-588-103 potential probe
gcttaatgaattcatgttttgttttcaaatgtgtccgtgctctgttttttttatcctttcttttaggtcgtattcggaataagcctgaggtggatgaagctgcagttgatgccatcctctccctaaatattatttctgccaagtacctgaagtcttcccacaactctagcaggtgggacacccagagcagtgtgaagaagtccacacttgcaggcgttaattggtacaccgttaggtgccttattcattaatgactcccagttcggacaaagaaattaactcccttctcccttctagcttcaaaaatctctttatttcttcacctgcctgctgtactctccaaaaagaaagaaagaaagtattgcagatatttgtatgtgatcagttactcttagagaatggaagtgatcctgtcccatgtgaagtttgaatagatgtaacaagtgataaatgaaaattggagaaagaaaacagtatattccccaaggatttaaaagtacraattaattattgccaagattaaattttttcctgtgaaatggttgctgtggagagaaaggtttctctcactccccaagtatcatggaaatgtgccctctgagataaaatgaagcctcttgtgttaagtctttgctgctgctgactataggctccattatccttagtatttgtttttcatttatgcacaaaagcgataaataatatgaactcttatgaccaagattggctgccataaataatagattttactttgttttttattttaaatgtttcacttaaaattatcttttataatcaggtgataacagacagttcgtaaagtacatagccattctgctttcctttgtaagactagaactaaaccagctgggatcctcttacctcacccaggaagggagttctcattgtctcagaggctccgtctctatatcctaggggctgggaaacaggagcggctgcctcttctaatgtgggctgagcacactgccttcccaccacag

SEQ ID NO: 268 - DNA, 1001 bp, Homo Sapiens
  allele 501: 12-589-152 : polymorphic base T or G
  misc_binding 481..500: 12-589-152.mis1, potential
  misc_binding 502..521: 12-589-152.mis2, potential complement
  primer_bind 636..654: upstream amplification primer, complement
  primer_bind 190..210: downstream amplification primer
  misc_binding 489..513: 12-589-152 potential probe
  misc_feature 393,614,617,695,819,849: n=a, g, c or t
ggctgggtgtggtagctcacgcctgtaatcccagcactttgggaggctgaggtgggtgaatcacctgagatcaggagtttgagaccagcctggccaacatggtgaaaccccacctcaaaaaaaaaaaaaaagacatcaaaggcatgaggtgtaggcatcgagtgcagagaggactccaggcaggggacatgtgcgatggctctttaatggcccaggccttgaaatgggcaagtctagctggggtgcccataatagaggagggtgatctgtgtatgtgttgactttgaaagtgaaattatccatttgataccttacgccaaattctttgtcttttaaattctgttgcagtagttgttgtttgagggtcttgtttagaactttttagaacttttncattcttacgtttttttacaccagagcttcaactctctgtttcttagcatttctctctctcctgctttggagcagactgaaagggaagtggcattatttcatctgatktaatgttcatttgcagttatttttgttatatgtttcatttgtatttcatttatgctctagttatgttaacatttgtttttctgtgatgtattatgtctgttttcataattttncanttactttgagttgaaatcccaaatacccagtctatcctcctcctctctttgttttaaaatagatttcagagcaggaanaagcatcagataaacatgtatgtcacttggttttgtttgatttattgatacaagtgtctgtctttgtcttttgtcttatgttcgaagatcagcatataccaaatgggaagactggaatcatagntaggaactagattctatttccctttcactnaattggaatgaacactctagctttgtgaccaccagtttttattgcttttttaaaaaagtagtagctacacaataaagaagaaaatacaaatgtgataggactttgctagtttgcttgaaatataaagtgttagagctataatttagctttca

SEQ ID NO: 269 - DNA, 1001 bp, Homo Sapiens
  allele 501: 12-592-118 : polymorphic base A or T
  misc_binding 482..500: 12-592-118.mis1
  misc_binding 502..521: 12-592-118.mis2, potential complement
  primer_bind 384..402: upstream amplification primer
  primer_bind 830..849: downstream amplification primer, complement
  misc_binding 489..513: 12-592-118 potential probe
ctcaaaaccagcctgggcaacttagtgagcccccatttctacaaaaaataaaaacaattaactgggcatggtggtacacacctgtagcctcagctactcaggaagctgagatgggaggatcccttgagcccaggagtttgagactgcagtgagctatgatggtgccactggcgcctgggtaacaaagcaagaccctgtctcaaaaaaaaaaaaaaaaaaaaaaaggagctgggcatagtggcatgtgcctgtaaatgaaaggcatcatttcatgcaagctcctctgagcccaggagttccagcctagcccaggcaacagggcaagaccacgtctcaaaaaaaaaaaaagtactctttccacctaaaatatattcaggtcatttgagttcagtttgagttcagctacgagaattatttagttgagtgagtgtcagagctgggattttcaaatctgcccttactggtatgttgctttacacaccctcttacgtaaatcaaacwaggattccaccctgggaggtttgcatagagggctgttcttgtagaacttgtgctcatgctttgatttgggatttggggagttagggcaagccagaaagtttttctggtggataataatgtgggttgactttcttaagcattttaagccaagcacttgagtttctaacaactaaaaagctaagtcagcctgacacagctctagcgcgccctggcttgattctgttcatccccagggggagacttgcctttgttccagtcctgctctcccaagccagcttactgtagttttccagcaattctgagaagcagtattttttactgctgattagaaccttaacatggaaatggaaagtttgtgtagcatgtaacattattagaagggaaaacatgactatatgattagatacatattgattttatgcaatatgtttgcataaaatctcttcagtagtaacttggttaaattattcacattgactcagcataatttctcccttgct

SEQ ID NO: 270 - DNA, 1001 bp, Homo Sapiens
  allele 501: 12-593-174 : polymorphic base T or C
  misc_binding 502..520: 12-593-174.mis1, complement
  misc_binding 481..500: 12-593-174.mis2, potential
  primer_bind 658..675: upstream amplification primer, complement
  primer_bind 138..158: downstream amplification primer
  misc_binding 489..513: 12-593-174 potential probe
  misc_feature 22,187,214,652,684: n=a, g, c or t
aggtcaaagtataaggattctncaaaaatgcagagtaattatgaaaattctgtttaaaaagcttcagaatagaatgtttatatagcattgatttggagctaagggctatattctggtaacataacaaggtgctatctagtgaatgtgtgattgtgtagtcatggagctgatgtccctgccatagaanttacagaattatctaaaaagggaaatnctataataatggccttcaatgctcccacacttggactagccattgccataggcagaaaggcaatctcatctttactgtgtgtgcaaacagtactttaatgtaatgtgtgcttaatataagctttctttaaaaaaaaaaaaggtggctcctgtttttgaatagctatttttaagatagatatagttaggaatctaaatgtgttctatatagttaatatccattatgaggtggctctgaaaaatcaacctagtataagttggatggctttgcttttctgcttctgttayaacccatttttctagaaaagcttccacttctacttaaagataagaggcaaatcattttcctgttcccttatgcacatagatgttcacttaccaaatatttatagagtggcccagccctctgcagacagtggtgagcaaaaccagacatggnttcctgccctcatagacttatagtctgatggnatgacacagacataaattaaataattgcacaaataaatgtaaattatagcagtgatgaaatagttgtgtgtgttgtcggagatcacataacgttgggggacctgttatgagaaagtggtgtttgaaataagacctgaagatgtgaaatcaaaggcgtgaggctgggtgtggtagctcacgcctgtaatcccagcactttgggaggctgaggtgggtgaatcacctgagatcaggagtttgagaccagcctggccaacatggtgaaaccccacctcaaaaaaaaaaaaaaagacatcaaaggcatgaggtgtaggcat

SEQ ID NO: 271 - DNA, 1001 bp, Homo Sapiens
  allele 501: 12-596-124 : polymorphic base A or G
  misc_binding 481..500: 12-596-124.mis1, potential
  misc_binding 502..520: 12-596-124.mis2, complement
  primer_bind 378..397: upstream amplification primer
  primer_bind 805..825: downstream amplification primer, complement
  misc_binding 489..513: 12-596-124 potential probe
gacagaccaggtcatctggcttccgagatcatcagagaagataagtctgtctctttcagctgccagtaagttttccaggatgagaggggaaaaagaaagcctccagtgacttcagttgctttgccagttgtcttgggattgttttacaccatcctttacttcccttgctcagacctctctgtttcaccattgctcaggcattcaggaaagtatctgctcactcccacttggtgagtcctcggccttgaggttgctgactctcaggcgttaggcagctggatgacttcccgcttcacgcagcaaaggccaggggcttgcgcgcctctgcagagttgttgctagggagacttgtgtcatcatccacaaccttgtttctcacttcctggttgggctcatctctgaagaacaggtctcccagcttcgctccttatcactgcattgtgaagaggaggaaaagtgaatcacggagagagaaaggaaaggatagaatcacaggctgcrtctgcacctgaaaagtgacccgcggaaactctatggcggattttttttttaactttcttcttcctgttaaaacataggtcactaactgtgatgttatttgttttctaagtggtatgtgagattttctaatgtagttagaagtttcattgtctgatggacacaatatgcccttccggttctattcaaaccagcaggatctgtcggtgcttagagatggctgcctggactggaatcaaatctaatttcagggaaatgaagatggaatttgaaggtcacttttaaaattaagtcattgatgctgctgttacagagtgtgacagaggatccatgtctgtgacacaggacggtgggaagcctgagagagagtgaaattatgtgatacactgaaatgacttttgtttttcttctaactcatacaaaactggtttggaaagtctttgctttggaagcgtcagacattagaacaggccaaactggactgtctgttcatagcgtgcctg

SEQ ID NO: 272 - DNA, 1001 bp, Homo Sapiens
  allele 501: 12-602-196 : polymorphic base C or T
  misc_binding 481..500: 12-602-196.mis1, potential
  misc_binding 502..520: 12-602-196.mis2, complement
  primer_bind 307..325: upstream amplification primer
  primer_bind 704..724: downstream amplification primer, complement
  misc_binding 489..513: 12-602-196 potential probe
ggccagcctgggtttctccagttgggtctcataatgcatctgcaccctggcgcagcatgttgccatggcacggtttcgcttttgccgtattactttggcagataagattctaggccaaataggtcatttgcctgtttcatcgaatctaaggacttggcctaagtgtggcgtattttgatggtcctcagcacgattattttctttttgtgagaaactaacttttgtcatattgtcgtttttagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaaggtccgtcctgccctgccttggtttcttattgccacgtgtgcccttctcttttgatttctgcactcyctgttacgtggtgtgaaatttccctattctctctggttttgaacttcctttgtgaagtgctatatgccttgggaatatggcaaggcagtccccattgctgtctctgtagtaactttcttgtctacctgcatttttctttcagacaccaaacacctttgctgtctgcacaaagcaccgtggggtccttttgcaggccctcaatgacaaagacatgaacgactggttgtatgccttcaacccacttctagctggcacaatacggtaagaagttttgttgttgttgttgttgtttttgagacggagtctcactttttctccctgaagtgcagtggcttggtcttggctcactgcaacctccgccccctggttcaagcgattctcctgactcagcctccccagtagctgagactacaggcacgtgccaccattgcctggctaattttcgtattttttgtagagacggggttttaccacaatggccaggctggtctcaaactcct

SEQ ID NO: 273 - DNA, 1001 bp, Homo Sapiens
  allele 501: 12-602-350 : polymorphic base A or C
  misc_binding 481..500: 12-602-350.mis1, potential
  misc_binding 502..521: 12-602-350.mis2, potential complement
  primer_bind 153..171: upstream amplification primer
  primer_bind 550..570: downstream amplification primer, complement
  misc_binding 489..513: 12-602-350 potential probe
tggcctaagtgtggcgtattttgatggtcctcagcacgattattttctttttgtgagaaactaacttttgtcatattgtcgtttttagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaaggtccgtcctgccctgccttggtttcttattgccacgtgtgcccttctcttttgatttctgcactctctgttacgtggtgtgaaatttccctattctctctggttttgaacttcctttgtgaagtgctatatgccttgggaatatggcaaggcagtccccattgctgtctctgtagtaactttcttgtctacctgcatttttctttcagacaccaaacacmtttgctgtctgcacaaagcaccgtggggtccttttgcaggccctcaatgacaaagacatgaacgactggttgtatgccttcaacccacttctagctggcacaatacggtaagaagttttgttgttgttgttgttgtttttgagacggagtctcactttttctccctgaagtgcagtggcttggtcttggctcactgcaacctccgccccctggttcaagcgattctcctgactcagcctccccagtagctgagactacaggcacgtgccaccattgcctggctaattttcgtattttttgtagagacggggttttaccacaatggccaggctggtctcaaactcctgacctcaagtaatccacccacctcagcctcccaaagtgctgggattacaggcctgagccactgcacccagcctagaagttgttctgtgttttctttctctctttggcttttggcttcaggaatatcaggataaataggaaaggaagaatttttc

SEQ ID NO: 274 - DNA, 1001 bp, Homo Sapiens
  allele 501: 12-603-191 : polymorphic base T or C
  misc_binding 502..520: 12-603-191.mis1, complement
  misc_binding 481..500: 12-603-191.mis2, potential
  primer_bind 668..688: upstream amplification primer, complement
  primer_bind 240..260: downstream amplification primer
  misc_binding 489..513: 12-603-191 potential probe
  misc_feature 339: n=a, g, c or t
tctatgtttttgcaggctctttcttgataaggatattcctaggtattgtctgtttgcttttttgcacgtaggattctagtttatcagaatgctttctgtcttatgttgctttgccattttaattttgtagtcccctccccatgtaaacctactgtacctaggatagagtagaccctgttctgtaccctaagaagcgtatagcttcttaaatgatttttagagtttcaaattattttttcattccatttgctaaacttgtcagttttattcttagactctttcaagttttcctcttctacattacaaagtagaatgtttctcccttcatttcatacaganatctcaggttttgttttctgttttcctctttatctgtcttctctccgtcaaaagcatgaagggtttattgctttataaaacctgagtccattgcagtcttgcaaaactgttcactttcttctctgttttgtcctgtgtggtaatagagacaaatttggctayttggatagctgagtctatgagaaatattttatatatattttttaacatttatctttctcctgtcagggctgcttgttttatctgtttattttcttcttttggaataggaaaaatcctggtttggtattaaaggaagttttttaaaaaatctgtctcatttagggaagaaaattgaaggaagtgatacatgacaatataacctaaaatgttaaaaaaaatacaacataaacgggctgggctcagtggctcacacctgtaatcccagcactttgggaggccaaggcgggtggatcacgaggtcaggagttcaagaccagcctggccaagatggtgaaaccccatctttactaaaaatacaaaaattagcctggcatgatggtgggcgcctgtaatcccagctactcaggaggctgaggcagaggatcgcttgaacccgggaggcggaggttgcagtgagccgagatcgcgccactgcattccagcctgggcgacagagcgag

SEQ ID NO: 275 - DNA, 1001 bp, Homo Sapiens
  allele 501: 12-783-73 : polymorphic base G or C
  misc_binding 481..500: 12-783-73.mis1, potential
  misc_binding 502..521: 12-783-73.mis2, potential complement
  primer_bind 429..446: upstream amplification primer
  primer_bind 858..878: downstream amplification primer, complement
  misc_binding 489..513: 12-783-73 potential probe
  misc_feature 202,209,236,281,447,461,627,992,995: n=a, g, c or t
ctagtcgtgtcttaccatctagaatttctagtttcagttatttccaatgggatgtgatttacagactctagcaaggcatacagtatagctttccagattttttgttgttttcctcctagttttttattcatgtcatcctcacttactttgactattgtttgtttcactggattgctgttaattgttctttctaaaacattanccttagnttttctttcacagaaacagtgctattnctttttgtgttcattttttattggtatatataatacttaacgtgnttcactcagcaaacacacgagtgctttactatatgccaagcatgattctaaatgctggggatatactagtgaagaaagcaaagtgcctgccctcccggagctgggaagacagacagaaataaatatacaatatcaaactagttagcgatgactgtgagaacgaagnagtaaactgggacnaagatccggtgattgcagaaggcttctgaggaggcgacastgcacagagacctaagtgaagtgaggagcccttgcctctgaggagacaacacttctggtggccagaaattcagtataaccaggttcagaacaaacacaactgactctgggttagcataaaactcanccagcaggagcagaagtccccaggcagacgcgagcagagcctgctggcaaccgtgagcattggtcagcgtggacattggacaaggggcttccttgctcagccctcattcctctaacatggttctctcctgtgttctgcatgtaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggtaatgttatgcttttcacatgggccctttngtncactat

SEQ ID NO: 276 - DNA, 1001 bp, Homo Sapiens
  allele 501: 12-783-421 : polymorphic base C or T
  misc_binding 481..500: 12-783-421.mis1, potential
  misc_binding 502..521: 12-783-421.mis2, potential complement
  primer_bind 81..98: upstream amplification primer
  primer_bind 510..530: downstream amplification primer, complement
  misc_binding 489..513: 12-783-421 potential probe
  misc_feature 99,113,279,644,647: n=a, g, c or t
agtgaagaaagcaaagtgcctgccctcccggagctgggaagacagacagaaataaatatacaatatcaaactagttagcgatgactgtgagaacgaagnagtaaactgggacnaagatccggtgattgcagaaggcttctgaggaggcgacactgcacagagacctaagtgaagtgaggagcccttgcctctgaggagacaacacttctggtggccagaaattcagtataaccaggttcagaacaaacacaactgactctgggttagcataaaactcanccagcaggagcagaagtccccaggcagacgcgagcagagcctgctggcaaccgtgagcattggtcagcgtggacattggacaaggggcttccttgctcagccctcattcctctaacatggttctctcctgtgttctgcatgtaggcctttgaggattggaataagacagagctagactcattcctgattgaaatcacagccaatattctcaagttccaagayaccgatggcaaacacctgctgccaaagatcagggacagcgcggggcagaagggcacagggaagtggaccgccatctccgccctggaatacggcgtacccgtcaccctcattggtaatgttatgcttttcacatgggccctttngtncactattctgatcttgatgtctggaggacagatacagactggtctttagagaatctcttcagccctctttagctttcagagtgccttttgctctttcttgcgttgaagaaactgacagtgtgagagaggctgacgctgcttttgattctcttccttgtagttcttatctcattcgtacaaactgtgaggtaaattcagaagtgactgtccttcctatccagttttatctttggaatattttagcattagtgatgtaattgtagtcagtgatctaagattttatttatgaggcaggtaacttgagtaaaatttttcatagaaaagttcatgaataacagggccgggcacagtggt

SEQ ID NO: 277 - DNA, 1001 bp, Homo Sapiens
  allele 501: 12-785-200 : polymorphic base C or T
  misc_binding 481..500: 12-785-200.mis1, potential
  misc_binding 502..521: 12-785-200.mis2, potential complement
  primer_bind 302..322: upstream amplification primer
  primer_bind 791..811: downstream amplification primer, complement
  misc_binding 489..513: 12-785-200 potential probe
ggaatattacccattgagcattgatttcacctatttaatgtgttttcactcataccctcaaacttagggcaggatagtgttcaccagatgaatctgttttttggaactgttgctattattctaatcaggcaactgatacgttttatggaaaacatctatttggttaactgatgtctgaagtgacaataatagtgagttgacctttgtcctacaatctcctaaaaagagcagcatctctacctggtgttagctctggggaaaagggcatgttgcttctgttgaaagcagcctcaaaggcgtcctgtgtttttatagtcgctcctctggcctgtgccgggaaggtatggctgcagagcactgtgaatgagttcacctgtcgtcagggaaccccaggaatgctgcggtgccagcaatacaggaatcagggatttggagcacttggcaaaagcatgctagtgttctcagacgggtgaactaatttggaagacaacaagttcataytaccagtctgtctgtccccccagttgaaaatagtttctttttctccattttttcttgatggaaggggtgtccttctgatggatttttctatctggcagtaaatctttgtgttgggtcctctttaactgtgcagttctttttatttcagactaataatagggagagagagagagagaacgataacatctcactatctgtgaaaataactaaatatagcccattgttttaacaaatctttccagagtatcttctgtgtgtcgagacctgtgggaaaacgcttgctgtctgggggagagaggcatataaatacattattacagtgaaatcattgctattaaggaaaaaaacattactagtaatgtgggaacacaaagctgccagggtaagtcaggaaagactgcctggaagaggtgacatttgaatccacaacagactcttatgtaactatgccatccacaggctctcgcactaactgtggaagcttgagtctgctaaatttt

SEQ ID NO: 278 - DNA, 1001 bp, Homo Sapiens
  allele 501: 12-785-393 : polymorphic base A or G
  misc_binding 481..500: 12-785-393.mis1, potential
  misc_binding 502..521: 12-785-393.mis2, potential complement
  primer_bind 109..129: upstream amplification primer
  primer_bind 598..618: downstream amplification primer, complement
  misc_binding 489..513: 12-785-393 potential probe
gagttgacctttgtcctacaatctcctaaaaagagcagcatctctacctggtgttagctctggggaaaagggcatgttgcttctgttgaaagcagcctcaaaggcgtcctgtgtttttatagtcgctcctctggcctgtgccgggaaggtatggctgcagagcactgtgaatgagttcacctgtcgtcagggaaccccaggaatgctgcggtgccagcaatacaggaatcagggatttggagcacttggcaaaagcatgctagtgttctcagacgggtgaactaatttggaagacaacaagttcatattaccagtctgtctgtccccccagttgaaaatagtttctttttctccattttttcttgatggaaggggtgtccttctgatggatttttctatctggcagtaaatctttgtgttgggtcctctttaactgtgcagttctttttatttcagactaataatagggagagagagagagagaacgataacatctcactrtctgtgaaaataactaaatatagcccattgttttaacaaatctttccagagtatcttctgtgtgtcgagacctgtgggaaaacgcttgctgtctgggggagagaggcatataaatacattattacagtgaaatcattgctattaaggaaaaaaacattactagtaatgtgggaacacaaagctgccagggtaagtcaggaaagactgcctggaagaggtgacatttgaatccacaacagactcttatgtaactatgccatccacaggctctcgcactaactgtggaagcttgagtctgctaaattttgtctgtacaaaatgacattgtttttatttttagtaaaaagcttttacaaaggaagaggagttaattgaatgtacttcttcactctctctaaagcattcttgcatatacctccatatagctaagtgatcagggtcagttaatttttcagtcatttttgaaataaaatctaaaatgccctctgtgcaatatggaa

SEQ ID NO: 279 - DNA, 1001 bp, Homo Sapiens
  allele 501: 12-787-103 : polymorphic base G or A
  misc_binding 481..500: 12-787-103.mis1, potential
  misc_binding 502..521: 12-787-103.mis2, potential complement
  primer_bind 583..602: upstream amplification primer, complement
  primer_bind 74..94: downstream amplification primer
  misc_binding 489..513: 12-787-103 potential probe
atatattaaaaaaattatttcttaaccctatttttctgttttgtgctaggaaaccgtatcatcatgggtaaaaaccatgttttccgctttaaccacccggaacaagcacgagctgagcgagagaagactccttctgctgagaccccctctgagcctgtggactggacatttgcccagagggagcttctggaaaaacaaggaattgatatgaaacaagagatggagaaaaggtaatgcacagttacgcagcccatatgactgtttcttcttttaaacatgtaatactaatagcattcttgaatttttttttttttttttacttctaggctacaggaaatggagatcttatacaaaaaggagaaggaagaagcagatcttcttttggagcagcagagactggtaggagtcctgaatctgctaaactgttgggaaaagggcagcttgttcccatactttccctgttccacagagcagtactcacccaaattgcttctgtctcartgataccaagcactattctttaatttccttaatggagaatgaacttaaatctcccggtagccttagcctgaaaaaatagtccacagaggtactcttttgggctttttatgtcttaaagccaaatcttaacttctgttacaaccaaatactttttaaggaaatagagcttttctggtagcctttgcctcttgatagtggttttggaatttgcttcagtggtggttctttaaatgataattactctgaatattgaatttggtgagagtttgccttggttttgtttctgatcacttgatagtactaattctctgctcttgggctgactttgggattgttcttacgctgggcagactttttttttttaagttaaactgtgtctaaaagtgttgctgcacagttgcatgtgttactcctttccttatcccctgcatggagtctgaattctcaatcaggttctcagtggcatgtgtggtagcggtgggagcaaaggctgcataccc

SEQ ID NO: 280 - DNA, 1001 bp, Homo Sapiens
  allele 501: 12-790-396 : polymorphic base G or A
  misc_binding 481..500: 12-790-396.mis1, potential
  misc_binding 502..521: 12-790-396.mis2, potential complement
  primer_bind 876..896: upstream amplification primer, complement
  primer_bind 423..443: downstream amplification primer
  misc_binding 489..513: 12-790-396 potential probe
gagactctgtctcttaaaaaaaaaaaaagaaaaaaacaattaccaacagaatgttcataaaaagttttttttgtttgttagtttttgtttttgagtcttgctatgtggcccaagctggagtgcagtggcaagattgtagctcgctgcagcctcagacacctgggctcgtgtgattctcctacttcagcctctcaagtagctaaaactataggtgcatgccactaggcctggctaatttttaaaaatttcttgtagagatggggggtcttgttaggttactcaggctggtttcaaattcctggcctcaagtgatcctccccacttggcctcctaaagtgttgggattacaggtgtgagctgcctcccgaggcctgtatttttttatgtatgagtaggtttcattactttagtctggaactctctacccttcttccatgaaagacacttgatgtaatggaataaacactatacagtctcataagttgggtttaagtcctctcrctgttatttccattgtgatcttgggcaaatcacttaaattcatctgagcctttttcttcatctttaataggtactataaagctttatacaaatgtattattatcaaggctcataaaatgtaaacactcaggatatttgatttagagataatagtatgttacttatgagaagtagaacatatgagaaatgacaagaacaaattttctttttggatctagatatgcagatcgtgcaaaacaaattaaatgcaatgctgttatcaatgaggaccccaatgccaaactggttcgtgaattaaaggaggaggtgacacggctgaaggaccttcttcgtgctcagggcctgggagatattattgatagtaagtgaattaaggatcgttacaaaatctaatcctttcttcttcagggttcttattcagcgttcttatatttaaaataaacttcaagttaaggagcatgatgaagctaaatggtagtgaaaatgttttgttttgtttt

SEQ ID NO: 281 - DNA, 1001 bp, Homo Sapiens
  allele 501: 12-791-211 : polymorphic base A or G
  misc_binding 481..500: 12-791-211.mis1, potential
  misc_binding 502..521: 12-791-211.mis2, potential complement
  primer_bind 291..311: upstream amplification primer
  primer_bind 671..690: downstream amplification primer, complement
  misc_binding 489..513: 12-791-211 potential probe
tacattggaatcttttagtttgtaaatgcagaaatgattctgaacctgtaggataccactattaaagacagacatgttttagaactgccatctagaacagttgtaacctgtgtttgtattatagcgtgtcttggtcttggcgctttaatgctgtcctttcttacaacgatattccttcctgtctttttttcttcctctgcttctttcccttttccctacttttcctgccttctcttctttctatctcccagatctgaaagattttcagaacaataagcatagatacttgctagcctctgagaatcaacgccctggccatttttccacagcatccatggggtccctcacttcatccccatcttcctgctcactcagtagtcaggtgggcttgacgtctgtgaccagtattcaagagaggatcatgtctacacctggaggagaggaagctattgaacgtttaaaggtaagtaatagttcagactgaatacaaggtattctatrtagctccacaaggaagaactaggagtaaaaatcactaagatttcgactcagcatatggagaactctttgactcttagaagtgtcctgaaaattgaattttgtgctttgtaagttaatttcttttcattagaatgcctgagtctgacatggccaggcagagttgggagaagtgcatgggcagttcataggctggcaaggcagagtaacagattaatagatgtgtacgttaattctgggatagtacatcaagttacagtgtaattgttttgttagaaatttatttggaaacgtggtttcattgaaagatggaattctgtgtagagccatgcttctgttaataaagatgaagtttgggccgggtgcagtggctcacgcctgtaatcccagcactttgggaggccgaggcggggtggatcacgaggtcaggagatcaagaccatcctggctaacacggtgagaccctgtctctactaaaaatacaaaaaattagccgggcgtgg

SEQ ID NO: 282 - DNA, 1001 bp, Homo Sapiens
  allele 501: 12-792-233 : polymorphic base G or A
  misc_binding 481..500: 12-792-233.mis1, potential
  misc_binding 502..521: 12-792-233.mis2, potential complement
  primer_bind 712..732: upstream amplification primer, complement
  primer_bind 284..304: downstream amplification primer
  misc_binding 489..513: 12-792-233 potential probe
  misc_feature 204,218,454,485..486,512,566,576,579,614: n=a, g, c or t
caggtgatccacctgccttggcctcccaaagtgctgagattacaggcgtgagccaccgcgcctggcctgtttgtttttttaacatgatttttctctaagcttaaataccacaaggccaaagagaaatggtcataatttaaaccattattatattgttgaggtatccctagctattattatagcaaagtgggaaaaaagtgtttnattctattgaagtntatgtaatgatccgacattaatgggaatatagaggagtcctaattaattggtataatttcacaaagcggaatggtattccttggagagttaaagacattctctttagtaagtgtaaaccaaagggcattttctttattcctgcttctaattccttctagcccagtgaattatttctcttttcactggtaatgtgatgaatgggaattgtttattacattgaagtgacttgaagtgnccttttgtgctttaggtgcaggttgacactnnaaaaaaaacaaaacrctgaatttttnacacctatgtctgcattaaaggctgttttactaccggaagttacatagacttcntgcagtcagntgntgtgccccagtgccttactggtcctttgtagattngccttaatgatttgtacaaatgactgggaggcggggatgctgcctgtgtcctggtgaaccttaatgaaggggccgtcttaggcacagtgcaaaacaagcatttgtcctgtactgttagagccaaaattgtgatgagcaatactgataattgtccagtttatgtcatctttcccagattttaaaatctgttctagatattcttagcttgaaccacttttgattgtgaaatgtattaggtgttgtcccattattactgtaaaatgaagttttgaatcttcttgttaataaactgtggatttcccctctcaatttcttaaacaacaacaaaaaaatgcttgaagattgtctttgagtgtaagatctgccttttcagaaagggagtgttag

SEQ ID NO: 283 - DNA, 989 bp, Homo Sapiens
  allele 505: 12-793-383 : polymorphic base T or G
  misc_binding 485..504: 12-793-383.mis1, potential
  misc_binding 506..525: 12-793-383.mis2, potential complement
  primer_bind 866..884: upstream amplification primer, complement
  primer_bind 365..385: downstream amplification primer
  misc_binding 493..517: 12-793-383 potential probe
  misc_feature 505: n=a, g, c or t
agaaataccaacaaaaaacttgtgtagcttgtaaggaggttatttggcttgagagggaagaggtgggacagacatgggggacaaagctacagcatatggctctgtggtgctgcttttttccaatagttgatgaaatagtgaaataaaagttaactttggttgggcttggaataaaggagatgatacataataaactattctttggttagcattagtaatgcttgtagacactcaaacaaggaaggcgaagtcctgatgatgatttattgtatcaatacctcattttatttggttgtggtctcagtttgcctcactggagaatccactaagaaagatggattttaatgggaagaaaagaattattttctacatcgttcctcatctcttgagtttgtcaaaaagttttctaagaggcagtgtgaagagccagagatgtccgaaattgcctgacttcatgttttggaagattcctaagtcacatgaaatcatctatcaaacacttgtkcttccaaacggtgtgaaaaactacagccaagatagcagttagcattcaaggaagccttaaagattgtgattatgtttttttttcctttgcgtgtgggcactatgctttattagaacacattatttttaatcatagtattttttctttgcctctaagaaaatactttcttaatgctcagaaagttgcttccaattaatgtttttttccccttaaaaagagaagctttgagagatatttttgctttcatagctagaacagttgaagtcttcaactgaggttttatagcagattagacatgggtaaatgatgtctgtaatgggttgagttactgagatgacaatctcctgtgccatttggtttgaatgtacttgataggctgcttcaaatcagtcacttcaatgcattttgtgtaaacccagttgtccttttttattcctctttagacataaatgtgctaactattcctttctatacacaatttatt

SEQ ID NO: 284 - DNA, 1001 bp, Homo Sapiens
  allele 501: 12-803-125 : polymorphic base T or A
  misc_binding 481..500: 12-803-125.mis1, potential
  misc_binding 502..521: 12-803-125.mis2, potential complement
  primer_bind 605..625: upstream amplification primer, complement
  primer_bind 169..189: downstream amplification primer
  misc_binding 489..513: 12-803-125 potential probe
caggagaatcccttgaacccaggaggcggaggttacagtgagctaagattgcgccaatgccctccagcctgggcaacagagtgagactccatctcaaaaaaaaaacaaaaacaaaaataatgtgcttgtttcttccttcagaacatgtaagtggaaagtgagtgaagttctgcaacacctagcaaagggagaaggagtgagaaatctttccattaaatgttgtaggctgcagggtaacttttactgttggtaaaattgactttgaaattttactaaagaccttagtgaagaggagtggtaagactccattcacacattttctcacaataggcgtcagtgaccatgttgctttgcagggctcttttcagagccagagtgagaaatagggagctccttgggaatgagaagtaaaactcccacttactgagtccttaatataaaatgttctttttctttggggatcttaagtcttaactatttgcttattaaagccttagctcwtacacttgagattaccctttcctttgaccttcctcttgatgtaaaggagaaatttctccctaactgccaagtgggaccaattgaaaataatgtcacatgttaggagtcaagacattaaccagactcttcaagattcaggtaacccagtgtcttccaaataatttctagggaataacactgtcattattcagggaactctccttccgacttccctatgtcccactaaagcaagacaaaactgtattacttcaatcagaaaacaaatttctctgttttaattcttccttacgccaaaataaagaactcttctgttttccctagttttattctagaaagaaaacagcttccttagtgttttgtgttgtcttgagtttttaatgcagtgtggtagttcactgaagcataagcaccttagttctgctcttattttgtgaatggtgagaatttctttcgggcagacctgcattttaatgctgcacgcagataacatctttcatccg

SEQ ID NO: 285 - DNA, 1001 bp, Homo Sapiens
  allele 501: 12-805-115 : polymorphic base G or A
  misc_binding 481..500: 12-805-115.mis1, potential
  misc_binding 502..521: 12-805-115.mis2, potential complement
  primer_bind 596..615: upstream amplification primer, complement
  primer_bind 135..155: downstream amplification primer
  misc_binding 489..513: 12-805-115 potential probe
  misc_feature 313,721: n=a, g, c or t
gagccaccgcgcccggcttctgtatgtgatttctttttcactctaattcactttactaatttgttcataggtgagctacatggaaatttactgtgaaagagtacgagatttgctgaatccaaaaaacaagggtaatttgcgtgtgcgtgaacacccacttcttggaccctatgtggaggatctgtccaagttggcagttacttcctacacagacattgctgacctcatggatgctgggaacaaagccaggtatggtaggaaatagagtaatgactgaggtctttggcaccttttgaggtccttttttcccagnttaagggtttgaggccacatttatagctatgaaagttgctttaattgtggagtcctctgatcctttgactgtgctgtaacagtgagggcttcagagtgttaagtatcttctcatctaaacagtacattgctgaaacatgttagagctctcattgagttttactcttaggttttgatcaagtcatggtraaatgttagttatcatgtatatatgcggctgtggtagtaattgattctggaataaatgagcaccaataaagaataaaaattaaatgcttcattggtttctaaagggatagctggagtatgaaaaatgattctgatggggtgcctttggaattggagagtaacttgatgggctcacaaataaggcagtattgagagcaattgtgtaagtgacaatcttgcnaatctgtgaataagtttaagactattgcttgtgattgttatgcttataatgtggagcctgctgtccatttcaactctcatctaagaattcccttgtcacgtggtcacctttatgtttatttaggacagtggcagctacaaacatgaatgaaacaagtagccgttcccacgctgtgtttacgattgttttcacccagaagaaacacgataatgagaccaacctttccactgagaaggtaggagagtttcagtctctaggcttgagttgtgaaggatggaga

SEQ ID NO: 286 - DNA, 1001 bp, Homo Sapiens
  allele 501: 12-808-52 : polymorphic base A or G
  misc_binding 481..500: 12-808-52.mis1, potential
  misc_binding 502..521: 12-808-52.mis2, potential complement
  primer_bind 450..469: upstream amplification primer
  primer_bind 894..914: downstream amplification primer, complement
  misc_binding 489..513: 12-808-52 potential probe
ccttgtgatccacccgcctcagcctcccaaagtgctaggattacaggcttgagccaccgtgcccaacctataattatttttttgagatggagtttgactcttgtcacccatgctggtgtgcaatggcaccatctcagctcactgcaacctctgcctccccagttcaaacaattctctttcctcagcctcccaggtagttgcaattacaggtgcccgccaccacacctggctaatttttaaaaatatttttagtagagacggggtttcagcacattggccagactggtctcaaactcctgacctcaggtgatccgcccacctcggcctcccaaagtgctgggattacaggcgtgagccaccgtgcctggccatgttgggtttttttgggtggggaagggtaaatggggatttgaaaagttgaacatgtcaatttaatttaacaagccctcatcacgagcagagcatgagcaggggccactgtcctgggtgtttggggagaarcagaagaagggagggaggagcagccctcaggttaaaagcaatgatttgttccaaccaatatttgagtacccaccctgtgcctggtgtgctgctgggtgcagtaattcagcagccaacaaagcaagcccatgcacttgtgccctcccattccagtggggaagacaatgtttaaacaaatttacaacatcggtcctaagtattttggaggaaagcagctaaataaaaggatgaaagagggatgggaacgagggatgtttagatggcatagtcagggaaggcctctcttcggagatcacatttgagcagactctagaatgaaaggatagggtaagccatgcaaacccctgggcaaagaggtctccaagtagagaaatgaagcccttgaggcagcagtgtcctcagtaggttccagaaatagcaaggtcgctggtacagagtcagggactgggagcgcaatagaagacatcagaaagtagccagggaccaggatatttagggct

SEQ ID NO: 287 - DNA, 1001 bp, Homo Sapiens
  allele 501: 12-808-75 : polymorphic base G or C
  misc_binding 481..500: 12-808-75.mis1, potential
  misc_binding 502..521: 12-808-75.mis2, potential complement
  primer_bind 427..446: upstream amplification primer
  primer_bind 871..891: downstream amplification primer, complement
  misc_binding 489..513: 12-808-75 potential probe
ctcccaaagtgctaggattacaggcttgagccaccgtgcccaacctataattatttttttgagatggagtttgactcttgtcacccatgctggtgtgcaatggcaccatctcagctcactgcaacctctgcctccccagttcaaacaattctctttcctcagcctcccaggtagttgcaattacaggtgcccgccaccacacctggctaatttttaaaaatatttttagtagagacggggtttcagcacattggccagactggtctcaaactcctgacctcaggtgatccgcccacctcggcctcccaaagtgctgggattacaggcgtgagccaccgtgcctggccatgttgggtttttttgggtggggaagggtaaatggggatttgaaaagttgaacatgtcaatttaatttaacaagccctcatcacgagcagagcatgagcaggggccactgtcctgggtgtttggggagaaacagaagaagggagggaggagcasccctcaggttaaaagcaatgatttgttccaaccaatatttgagtacccaccctgtgcctggtgtgctgctgggtgcagtaattcagcagccaacaaagcaagcccatgcacttgtgccctcccattccagtggggaagacaatgtttaaacaaatttacaacatcggtcctaagtattttggaggaaagcagctaaataaaaggatgaaagagggatgggaacgagggatgtttagatggcatagtcagggaaggcctctcttcggagatcacatttgagcagactctagaatgaaaggatagggtaagccatgcaaacccctgggcaaagaggtctccaagtagagaaatgaagcccttgaggcagcagtgtcctcagtaggttccagaaatagcaaggtcgctggtacagagtcagggactgggagcgcaatagaagacatcagaaagtagccagggaccaggatatttagggcttaggtgaggacttggaatttcat

SEQ ID NO: 288 - DNA, 987 bp, Homo Sapiens
  allele 501: 12-809-119 : polymorphic base G or C
  misc_binding 481..500: 12-809-119.mis1, potential
  misc_binding 502..521: 12-809-119.mis2, potential complement
  primer_bind 383..402: upstream amplification primer
  primer_bind 888..908: downstream amplification primer, complement
  misc_binding 489..513: 12-809-119 potential probe
  misc_feature 511: n=a, g, c or t
gctggagtgagttcaaagaagtatttttatatgtggacttgacctttggtcttttattctcattttccacttaagaaaatcttggctgtgtgaatgaaagagtgatacttttaaggttatagaaagtgaaatgtaatcatgccagataattttatatagatatttttatgtatggctgacctggatgactctaacagtgcatgtgtttgtgagtgtgtgtgtgtgcatgtgcgtgtatttaatgagaaaagtaaacttgtgtataggaggcttaaaaaatgtgtagggaattttaggtgactgttctgattccagacacttttattatggaagcaatcaagtaagtataggaagaaatattaataaaaggttatttatttctccttttactctttacagcccgaagatccctgttttgcatctcaaaaccgtgtgtacaatgacattggcaaggaaatgctcttacacgcctttgagggatataatgtctgtatttttgcstatgggcagnactggtgctggaaaatcttatacaatgatgggtaaacaagaagaaagccaggctggcatcattccacaggtgaaaaacaaaacaaaacaaaaatcttctcttcattattagtgttagtcttaaattgctttaacagttatttttatttggcgaacatttatgcggggattgttttatgtcaggcacaaagatgaacaacccattattttccctcagaggagctcacaattgaatgggaaggattgacatgtacacatgtctgtcattaaaggtgggaaagtcagtgttttgtaatgattttgccatatatccaatgccatattattttgtcatttgaaaagtgttaccagcttgttaaagctctgttctaagtcctggagatggggggatattgttgatctgattttttttcaaattccatgcatagattacctctgaagaatgtgattatttttggtttttttgatagccttatt

SEQ ID NO: 289 - DNA, 1001 bp, Homo Sapiens
  allele 501: 12-810-77 : polymorphic base G or A
  misc_binding 481..500: 12-810-77.mis1, potential
  misc_binding 502..521: 12-810-77.mis2, potential complement
  primer_bind 558..577: upstream amplification primer, complement
  primer_bind 126..146: downstream amplification primer
  misc_binding 489..513: 12-810-77 potential probe
ctggtctcaaacttctgactacaggtgatctgcctgcctcggcctcccaaagtgctgggattacaagcatgagccaccatgccaggtcttcctgtcaaataaggttttaaacatgcagctgtagccacagctctcgtgtttattagtctggcatcacagtcagtactgtgagtgccgttgcttaggcttagcctataaatatccacaaatatccattacagaagcaggcaagggcaaatgctgtgctaagcagcccaagggccacatttggaacccacttaggaagcatgctatgttcagtacagtaaaaccttggtgattcaatggcttcaacaaatgttctgtgtagtaagtgtttttcatggaaatatttctgacttgtcctggtgatttctgtgtttccttaactgaatcatcatcaagaagagattaaattgtttagctatatgaacataatttattaaccagtgctatacaaataactagagatgcagacagatrtgacgtgagaccaaagagtgaatgacacctgagcctggcattcctcggagcttaaagaagagttcctggtgtccctctgttttttggaattttttttttttcaaagaaagggaggaggattaaagatttatctcctcaacccctcatttctgaaccatgaatccacatttcaagttcatcttacattaggcccctagagtggggtatgggaagccctggacaccagcatgcctgcctgccagcagaatgagttgatgctcctgagactgaatgctgttttgcacttggcttccctatttatactaagtttgctactcaggcttgaacagaatatccttcactttttcttaacttagggtgaactgtttcatagaacatttacttgaaagcctattgatcctgttttatttgaagaaagaacagtgagtcagcaaatagctctagacctgtctcagtgagtagtgtgggctcacttagcttctctggtctgttggaacaca

SEQ ID NO: 290 - DNA, 1001 bp, Homo Sapiens
  allele 501: 10-265-178 : polymorphic base A or G
  misc_binding 481..500: 10-265-178.mis1, potential
  misc_binding 502..521: 10-265-178.mis2, potential complement
  primer_bind 324..341: upstream amplification primer
  primer_bind 662..681: downstream amplification primer, complement
  misc_binding 489..513: 10-265-178 potential probe
ctgggggtcgcctgagctcacttggggctctgtgaccctggccctacggcgtctcgggcccagagctccttccctgcgggcccggccccctgccctctcggccgcgcaggcatggggcggggcgggtcccttcgagggccagggaggaggcgcggccaggcctcgccgagtctgcagggacacctgcgggacgcgtgccagcgggagccgggcgcgagggcggggctgggggccgcctgcccggccgaggctctgcagcgtgcgcgcccggcttctgggggcccgcgggaggcgcggaggaaagtgcagactcccagtcacggccaaatgtggaaggaccggacccctgggttgcagcgcgtcgagcggtgctgactctttcctttgttctgtttctgcctctctagagctgacatcgcgctgatcggattggccgtcatgggccagaacttaattctgaacatgaatgaccacggctttgtggtaagcggcgtgggcgcrttgtcttctctctggttcccgggcgctttagccgaggccggcgataggtttgggagcttacgggtctcctggccgtgctttgctaatgtgctctgttgctgctcgtggcatttttgtatggaaaggagaagcaccctgtaggcgtgggcgggccgatcccgaacttagtcctgcggagtgtgcctgtgggtccgtgaggttcacagcccgaatgaacgaattagtgtcttaagtagagaagaagggtgcgggaggagaacccttgctggctgtgtagagctctaacttgattgcctgatgagatctggggagagtgaaaatgtttcttctaaatgttaaagtggcttagacgccaggatgatcaataacaacagatagagcctgttgaaccggccagttcctggatttgattttgagtcctaacacgttgggtgtggattctacctgacacaccgggggtagttggccttcgcctcggttgtccgccgttttcatcctac

SEQ ID NO: 291 - DNA, 1001 bp, Homo Sapiens
  allele 503: 10-266-203 : polymorphic base C or T
  misc_binding 483..502: 10-266-203.mis1, potential
  misc_binding 504..523: 10-266-203.mis2, potential complement
  primer_bind 301..320: upstream amplification primer
  primer_bind 701..720: downstream amplification primer, complement
  misc_binding 491..515: 10-266-203 potential probe
cagcccgaatgaacgaattagtgtcttaagtagagaagaagggtgcgggaggagaacccttgctggctgtgtagagctctaacttgattgcctgatgagatctggggagagtgaaaatgtttcttctaaatgttaaagtggcttagacgccaggatgatcaataacaacagatagagcctgttgaaccggccagttcctggatttgattttgagtcctaacacgttgggtgtggattctacctgacacaccgggggtagttggccttcgcctcggttgtccgccgttttcatcctactgaggtgacataactttacagtgagcctcccacagctgggggaagaaaaggcaaaggcaggtctgacctccccagaacttgggttgaatggaaaggtcattgttactttggccacagtctgaaagtcttgtgtgtcctggatctcctactcaggacttttgtccttctaggtctgtgcttttaataggactgtctccaaagttgaygatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtgaggccagctgtgctctcagctgctaccacgatagcagctgtttttggtttcttcctttagttctccttcttttaactctagagatttttttttttcaatttctgctaagctctgaccaaatgattgcttaactgttgcagtgttggttaacttgataagcgcttatgaagtaactttgtcctttggtggtagtaattctgagaatactaacagacatttcaataaacattaaggcggggcacagtggctcaggcctgtaatcccagcactttttgggaggctggttcagatggatcgtttgagcccaggagttcgagaccagcctgggcaacatggcgaaaccctgtctct

SEQ ID NO: 292 - DNA, 1001 bp, Homo Sapiens
  allele 501: 10-403-312 : polymorphic base C or T
  misc_binding 481..500: 10-403-312.mis1, potential
  misc_binding 502..521: 10-403-312.mis2, potential complement
  primer_bind 190..208: upstream amplification primer
  primer_bind 593..611: downstream amplification primer, complement
  misc_binding 489..513: 10-403-312 potential probe
ccctttccttccttgcagccccatcgtggcccagtacctgtctctgcccactgtattcttcttgcatgcactgccatgcagcctggaatttgaggctacccagtgccccaacccattctcctacgtgcccaggcctctctcctctcattcagatcacatgaccttcctgcagcgggtgaagaacatgctcattgccttttcacagaactttctgtgcgacgtggtttattccccgtatgcaacccttgcctcagaattccttcagagagaggtgactgtccaggacctattgagctctgcatctgtctggctgtttagaagtgactttgtgaaggattaccctaggcccatcatgcccaatatggtttttgttggtggaatcaactgccttcaccaaaatccactatcccaggtgtgtattggagtgggacttttacatgcgtatattctttcagatgtattactttggatcgattaactagccccagatatatgctgagyaagcattctgagataatttaaaatgccctcttttgttaatttttgactcctaggtttgagtctgtctttggcatcatcttctggatgatttcttggtatctgagatttcgggaaagcattccttggacattttactctgtgtgctccagtggatagtaatcaattagaaacaacaagctgttaaatgccataggcacagaatgctgggtttggggcaccctgcagaaaactcagttgaagcctgcaccttgccctggattcagtcaggcaggcaatgttcaggactgatgaaatcattctttgatgatgatagatcctggaaatgaaagttgcctttgtgaccctggttaaagctccagtttctaaatattctgataagaagctaaatcctgcagtccgttctcttctaatgagtgaatcaccagacagtcaggttctgacatgatacagaaaggttgtaggtttcattctcaagctattaggtttatttttcccctaca

SEQ ID NO: 293 - DNA, 1001 bp, Homo Sapiens
  allele 501: 10-405-54 : polymorphic base C or T
  misc_binding 481..500: 10-405-54.mis1, potential
  misc_binding 502..521: 10-405-54.mis2, potential complement
  primer_bind 448..465: upstream amplification primer
  primer_bind 848..867: downstream amplification primer, complement
  misc_binding 489..513: 10-405-54 potential probe
tggcttttccctgccacttcccaactattaatccaaaggttttttttgttgttgtggttgttgtcattgttttcaatttgactctcaaatactctattaaactatgatccaccacactcagaagtatcattttctctaagagactcaaaagtgtattagggagaatttatttaaaaataaaataaatgggatattgtttcttcatattaaatagaagtatttctccaaaaagctgttggttagaacactgaatttatgtcttacatttctgctcttatagttctgcatccacttgtttcattaagcaaactttcccttaaagtgcaggaaagtgaaaaaatcctaagtgcacagcttgataaattatcacaaattcacgtagtgcatacacccttgtaactaaacctccaaaacaagatgccggaagttgccagtcctcagaagccttcacagttactgatcctcccactctgttaaagactgttccttcagaggaccccygttttctagttagtatagcagatttgttttctaatcatattatgttctttctttacgttctgctctttttgcccctcccaggtcctgtggcggtacactggaacccgaccatcgaatcttgcgaacaacacgatacttgttaagtggctaccccaaaacgatctgcttggtatgttgggcggattggatgtataggtcaaaccagggtcaaattaagaaaatggcttaagcacagctattctaaaggattgttgagcttgaaaatattatggccaacatatcctacattgctttttatctagtggggtatctcaacccacattttcttctgcaaatttctgcaagggcatgtgagtaacactgagtctttggagtgttttcagaacctagatgtgtccagctgtgaaactcagagatgtaactgctgacatcctccctattttgcatctcaggtcacccgatgacccgtgcctttatcacccatgctggttcccatggtg

SEQ ID NO: 294 - DNA, 1001 bp, Homo Sapiens
  allele 501: 10-408-356 : polymorphic base C or T
  misc_binding 481..500: 10-408-356.mis1, potential
  misc_binding 502..521: 10-408-356.mis2, potential complement
  primer_bind 146..165: upstream amplification primer
  primer_bind 546..565: downstream amplification primer, complement
  misc_binding 489..513: 10-408-356 potential probe
agaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctcyggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaa

SEQ ID NO: 295 - DNA, 1001 bp, Homo Sapiens
  allele 501: 10-409-148 : polymorphic base G or C
  misc_binding 481..500: 10-409-148.mis1, potential
  misc_binding 502..521: 10-409-148.mis2, potential complement
  primer_bind 354..372: upstream amplification primer
  primer_bind 779..798: downstream amplification primer, complement
  misc_binding 489..513: 10-409-148 potential probe
ctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccacsgctgcccctactgcaaatggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaagtgttttcactggtgtcgcatttatttcttgttaagttgcattttctaattacaaaagtaatgcatgattatgacagaaagtttggaaaatat

SEQ ID NO: 296 - DNA, 1001 bp, Homo Sapiens
  allele 501: 10-409-249 : polymorphic base G or C
  misc_binding 481..500: 10-409-249.mis1, potential
  misc_binding 502..521: 10-409-249.mis2, potential complement
  primer_bind 253..271: upstream amplification primer
  primer_bind 678..697: downstream amplification primer, complement
  misc_binding 489..513: 10-409-249 potential probe
ccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcstgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaagtgttttcactggtgtcgcatttatttcttgttaagttgcattttctaattacaaaagtaatgcatgattatgacagaaagtttggaaaatatagaggttcacacacacatgccttcattgcgtgtgcatgcataaatgcatgagaaaagaaaaataaccagtaatcgcatcgcccagaaataaccccagttac

SEQ ID NO: 297 - DNA, 1001 bp, Homo Sapiens
  allele 501: 10-410-274 : polymorphic base A or C
  misc_binding 481..500: 10-410-274.mis1, potential
  misc_binding 502..521: 10-410-274.mis2, potential complement
  primer_bind 228..245: upstream amplification primer
  primer_bind 645..664: downstream amplification primer, complement
  misc_binding 489..513: 10-410-274 potential probe
tgcaaatggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaagtgttttcactggtgtcgcatttatttcttgttaagttgcattttctaattacaaaagtaatgcatgattatgacagaaagtttggaaaatatagaggttcacamacacatgccttcattgcgtgtgcatgcataaatgcatgagaaaagaaaaataaccagtaatcgcatcgcccagaaataaccccagttacaattgtggcaaatacacatacttataaatattgcagatatattaagtatacctagtatttgctaacactctttcttctactctgtcatgaagattctcccaaggtgtttttgtataatatttaattcattttcagtggccaagcagtattctacttcatggatataccaggatttatttaaccataacttctggttggattcactcttattattttgtttaattaaaaaaaaaagacctcggctgggcacagtggctcatgcctgtaatcccagcactttgggaggccgaggtgggtggatcacctaagatcgggagtttgagaccagcctggccaacatggcaaaaccccgtctctactaaaaatacagaaaattagccgggtgtggttgccagcacctgtaattccagc

SEQ ID NO: 298 - DNA, 1001 bp, Homo Sapiens
  allele 501: 10-410-280 : polymorphic base C or T
  misc_binding 481..500: 10-410-280.mis1, potential
  misc_binding 502..521: 10-410-280.mis2, potential complement
  primer_bind 222..239: upstream amplification primer
  primer_bind 639..658: downstream amplification primer, complement
  misc_binding 489..513: 10-410-280 potential probe
tggcagttttaatcttatcttttggcttctgcagatggttgcaattgatccttaaccaataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaagtgttttcactggtgtcgcatttatttcttgttaagttgcattttctaattacaaaagtaatgcatgattatgacagaaagtttggaaaatatagaggttcacacacacaygccttcattgcgtgtgcatgcataaatgcatgagaaaagaaaaataaccagtaatcgcatcgcccagaaataaccccagttacaattgtggcaaatacacatacttataaatattgcagatatattaagtatacctagtatttgctaacactctttcttctactctgtcatgaagattctcccaaggtgtttttgtataatatttaattcattttcagtggccaagcagtattctacttcatggatataccaggatttatttaaccataacttctggttggattcactcttattattttgtttaattaaaaaaaaaagacctcggctgggcacagtggctcatgcctgtaatcccagcactttgggaggccgaggtgggtggatcacctaagatcgggagtttgagaccagcctggccaacatggcaaaaccccgtctctactaaaaatacagaaaattagccgggtgtggttgccagcacctgtaattccagctaattg

SEQ ID NO: 299 - DNA, 1001 bp, Homo Sapiens
  allele 501: 10-410-337 : polymorphic base A or G
  misc_binding 481..500: 10-410-337.mis1, potential
  misc_binding 502..521: 10-410-337.mis2, potential complement
  primer_bind 165..182: upstream amplification primer
  primer_bind 582..601: downstream amplification primer, complement
  misc_binding 489..513: 10-410-337 potential probe
aataatggtcagtcctcatctctgtcctgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaagtgttttcactggtgtcgcatttatttcttgttaagttgcattttctaattacaaaagtaatgcatgattatgacagaaagtttggaaaatatagaggttcacacacacatgccttcattgcgtgtgcatgcataaatgcatgagaaaagaaaaataaccagtaatcrcatcgcccagaaataaccccagttacaattgtggcaaatacacatacttataaatattgcagatatattaagtatacctagtatttgctaacactctttcttctactctgtcatgaagattctcccaaggtgtttttgtataatatttaattcattttcagtggccaagcagtattctacttcatggatataccaggatttatttaaccataacttctggttggattcactcttattattttgtttaattaaaaaaaaaagacctcggctgggcacagtggctcatgcctgtaatcccagcactttgggaggccgaggtgggtggatcacctaagatcgggagtttgagaccagcctggccaacatggcaaaaccccgtctctactaaaaatacagaaaattagccgggtgtggttgccagcacctgtaattccagctaattgggaggctgaggcaggagaattgcttgaaccggggtcagggggttcggaggtcggagg

SEQ ID NO: 300 - DNA, 1001 bp, Homo Sapiens
  allele 501: 12-121-326 : polymorphic base A or G
  misc_binding 481..500: 12-121-326.mis1, potential
  misc_binding 502..520: 12-121-326.mis2, complement
  primer_bind 178..196: upstream amplification primer
  primer_bind 637..656: downstream amplification primer, complement
  misc_binding 489..513: 12-121-326 potential probe
ttcttgataccctcggacgaggcctaccggggtactcccagcacctcgtagtagtccactatgctggactgccaaagagcctgcggggcactggcacagcgagcggcaaggctgccagcacccgcgcacaggtcagaggcttggcgacctgggccgcctggagggccgccccttatgacgcagccacatctcattggccgaggcctgtgagcgcctcgcatcccaagatgcagtgctcctgggactggccctgctctctgtgaggctctgtgaggccctgtgatgctccaagaccaggccccgcccactccggcctccaaccagccatggtctccaaaaaggatgggaaaaagaggttggggaaaagagagggccttgactttggctgcctgaagaactgtttttcttaaagtaggctttatatcagtctttttcctcggccacaggagggaagagggtggtgggagtgagtttagtctgaccggggctgaagacatcctrttgtttaggactgcggttctccaacgttccagccccggtgcccatttgcttttgttcatctggattatgcctatcatatgtactgcattagagattaaaacagaattaaaaagacatattcattgggcaatttaagaagaataaacccatgacacactaacaaacctttttatgtaactttttttgagacaaaatgtagtgagaagagtggcatcgttttacagtttttgcatctctctctttagtacttggctctatagagaggtggattctcatgtcagcttctgcattctatctattgtgatattacacatcccccatgtagcttctggaaaactccactgtacacttgtgggagaatgacaatgagaaaatcaagtaacattattacggaaatagttttgactttgtaaaattctcctgaaaaattactggggatccctaggatttcctggctcatactttgagaatcgctagtctagcagagtagtccctggtat

SEQ ID NO: 301 - DNA, 1001 bp, Homo Sapiens
  allele 501: 12-122-341 : polymorphic base C or T
  misc_binding 481..500: 12-122-341.mis1, potential
  misc_binding 502..521: 12-122-341.mis2, potential complement
  primer_bind 162..180: upstream amplification primer
  primer_bind 595..612: downstream amplification primer, complement
  misc_binding 489..513: 12-122-341 potential probe
gcttcggcttgccctcagtgggatgcacccactatccaaccagtcccaatgagatgaaccaggtacctcagttggaaatgcagaaatcatccatcttctgcgtcgatcatgctgggagctgcagatcggagctgttcctatttggccattggtgctgaagcttccgttctcctctccaacacctcctttttttttccttttctcttccagtttttcaatgtgaacatattctctagagttaactacattggctcaaatcttcactatcatctcagtggagcagaacaaattgggaactgtggcacaggtcactcttgctatgccccttaagaattccacattaacaaagctaattttcgagtgtggtaaagaacaggctagtgtatttagtagtgagtccattgactgtttcccaacatgaggtcacactagatttaatatggtttggctctgtgtcccccaccaaatctcatcttgaattgtaatccccataatccccaygtgttgaggacaggacatggtgggaggtccccacctcctaatctcatcatagtgagtgagttcttatgagatctgatggttttataaggggcccttatcccttcacttgcaagctattcctctttctctctttcatgtaagacgtgtctttgcctctctctcactttctgccaggattataagtttcctgaggcccctccagccacatggaactggagtcaattaaagctctttcctttataaattacccagtcttgggtatgtctttatagcagtgtgtgaatggactaatacagtaaattggtgtcatggagagtggggtactgctataaaactacttgaaaatgtggaagtgacttggaactgggtaacaggcagaggctggaacagtttggagagctcagaagacaggaagatgtgggaaagtttggaacttcctggagacttgttgaacggttttgaccaaaatgctgataatgttgtggacaatgaagtccagg

SEQ ID NO: 302 - DNA, 1001 bp, Homo Sapiens
  allele 501: 12-122-381 : polymorphic base A or C
  misc_binding 481..500: 12-122-381.mis1, potential
  misc_binding 502..521: 12-122-381.mis2, potential complement
  primer_bind 122..140: upstream amplification primer
  primer_bind 555..572: downstream amplification primer, complement
  misc_binding 489..513: 12-122-381 potential probe
cagtcccaatgagatgaaccaggtacctcagttggaaatgcagaaatcatccatcttctgcgtcgatcatgctgggagctgcagatcggagctgttcctatttggccattggtgctgaagcttccgttctcctctccaacacctcctttttttttccttttctcttccagtttttcaatgtgaacatattctctagagttaactacattggctcaaatcttcactatcatctcagtggagcagaacaaattgggaactgtggcacaggtcactcttgctatgccccttaagaattccacattaacaaagctaattttcgagtgtggtaaagaacaggctagtgtatttagtagtgagtccattgactgtttcccaacatgaggtcacactagatttaatatggtttggctctgtgtcccccaccaaatctcatcttgaattgtaatccccataatccccacgtgttgaggacaggacatggtgggaggtccccacctcctmatctcatcatagtgagtgagttcttatgagatctgatggttttataaggggcccttatcccttcacttgcaagctattcctctttctctctttcatgtaagacgtgtctttgcctctctctcactttctgccaggattataagtttcctgaggcccctccagccacatggaactggagtcaattaaagctctttcctttataaattacccagtcttgggtatgtctttatagcagtgtgtgaatggactaatacagtaaattggtgtcatggagagtggggtactgctataaaactacttgaaaatgtggaagtgacttggaactgggtaacaggcagaggctggaacagtttggagagctcagaagacaggaagatgtgggaaagtttggaacttcctggagacttgttgaacggttttgaccaaaatgctgataatgttgtggacaatgaagtccaggctgagtctcagatagagatgaggaatctgttgagaactgg

SEQ ID NO: 303 - DNA, 1001 bp, Homo Sapiens
  allele 501: 12-124-169 : polymorphic base G or T
  misc_binding 481..500: 12-124-169.mis1, potential
  misc_binding 502..521: 12-124-169.mis2, potential complement
  primer_bind 334..352: upstream amplification primer
  primer_bind 830..848: downstream amplification primer, complement
  misc_binding 489..513: 12-124-169 potential probe
caagctgattcaggtaaacgggtaacaagtttgctgaggcctgggaggaggagaaagatgggagcagatggaaaggcatttggtgggctgggcacatgaggagtttagaagcccctaaaggacatgttctccttctgtcagagaagacttgggagttacaaagtctatagctgtgtccatccccaggggagaactgagagaaccttccatcccgagagccaggtggccaggagggcagcagggagtgacaccccttctgctagccgccagagccacagccattcctcagacccacagaacattattagcactggatcagggatctatggacttagtgatctggagatgtgggcaagggaagcgagagagggcaagtcagtactcaaggtcacgtagcattcccagagcccaggcaagaacaaggatgaaggcctttggcccttctcaccaacgtcttgtgcctccccagtttctgcgaaactccctcaagaagacccgggkgtctagctggagcctgcgcttgagcaaagagctgaacaaccagattgcgagctttgacagcccctctctggagaaggtttgtcttcatagggacaggagagtttggacaaggagtagactccaggggtgatggagtggagaggataacaccgtgtgtgtgagatcagctggacctgtggctgtttacagggtcctgggaggagaggagcgtggtctggattggtggttttagttttgttttggtttatttttttgctttgttttgttgatcctccagattctggctagcaatcacatgtgtgtatttctttgtaaacacaaaactataccgcattgctacaaaattctaaaacatttttgaaagaaatcagtgagggtctcaataaatagaaagcaccccatgttcatggattgaaagatgctatagttcaaatggtgatactctccaaatttatcttcagttttagcatgacacctatcacaatccaagctagttcttt

SEQ ID NO: 304 - DNA, 1001 bp, Homo Sapiens
  allele 501: 12-124-194 : polymorphic base C or T
  misc_binding 482..500: 12-124-194.mis1
  misc_binding 502..521: 12-124-194.mis2, potential complement
  primer_bind 309..327: upstream amplification primer
  primer_bind 805..823: downstream amplification primer, complement
  misc_binding 489..513: 12-124-194 potential probe
caagtttgctgaggcctgggaggaggagaaagatgggagcagatggaaaggcatttggtgggctgggcacatgaggagtttagaagcccctaaaggacatgttctccttctgtcagagaagacttgggagttacaaagtctatagctgtgtccatccccaggggagaactgagagaaccttccatcccgagagccaggtggccaggagggcagcagggagtgacaccccttctgctagccgccagagccacagccattcctcagacccacagaacattattagcactggatcagggatctatggacttagtgatctggagatgtgggcaagggaagcgagagagggcaagtcagtactcaaggtcacgtagcattcccagagcccaggcaagaacaaggatgaaggcctttggcccttctcaccaacgtcttgtgcctccccagtttctgcgaaactccctcaagaagacccgggggtctagctggagcctgcgcttgagyaaagagctgaacaaccagattgcgagctttgacagcccctctctggagaaggtttgtcttcatagggacaggagagtttggacaaggagtagactccaggggtgatggagtggagaggataacaccgtgtgtgtgagatcagctggacctgtggctgtttacagggtcctgggaggagaggagcgtggtctggattggtggttttagttttgttttggtttatttttttgctttgttttgttgatcctccagattctggctagcaatcacatgtgtgtatttctttgtaaacacaaaactataccgcattgctacaaaattctaaaacatttttgaaagaaatcagtgagggtctcaataaatagaaagcaccccatgttcatggattgaaagatgctatagttcaaatggtgatactctccaaatttatcttcagttttagcatgacacctatcacaatccaagctagttcttttttttgatcctaaaattgatcctaa

SEQ ID NO: 305 - DNA, 1001 bp, Homo Sapiens
  allele 501: 12-124-300 : polymorphic base G or T
  misc_binding 481..500: 12-124-300.mis1, potential
  misc_binding 502..521: 12-124-300.mis2, potential complement
  primer_bind 203..221: upstream amplification primer
  primer_bind 699..717: downstream amplification primer, complement
  misc_binding 489..513: 12-124-300 potential probe
cttctgtcagagaagacttgggagttacaaagtctatagctgtgtccatccccaggggagaactgagagaaccttccatcccgagagccaggtggccaggagggcagcagggagtgacaccccttctgctagccgccagagccacagccattcctcagacccacagaacattattagcactggatcagggatctatggacttagtgatctggagatgtgggcaagggaagcgagagagggcaagtcagtactcaaggtcacgtagcattcccagagcccaggcaagaacaaggatgaaggcctttggcccttctcaccaacgtcttgtgcctccccagtttctgcgaaactccctcaagaagacccgggggtctagctggagcctgcgcttgagcaaagagctgaacaaccagattgcgagctttgacagcccctctctggagaaggtttgtcttcatagggacaggagagtttggacaaggagtagactccaggggtgakggagtggagaggataacaccgtgtgtgtgagatcagctggacctgtggctgtttacagggtcctgggaggagaggagcgtggtctggattggtggttttagttttgttttggtttatttttttgctttgttttgttgatcctccagattctggctagcaatcacatgtgtgtatttctttgtaaacacaaaactataccgcattgctacaaaattctaaaacatttttgaaagaaatcagtgagggtctcaataaatagaaagcaccccatgttcatggattgaaagatgctatagttcaaatggtgatactctccaaatttatcttcagttttagcatgacacctatcacaatccaagctagttcttttttttgatcctaaaattgatcctaaaatttatatggaaataccaggggctctgaatagccaacaaaattatgagaagaagaataaagttggaggactcaaacttctcaatttcaacttcttacacaactgc

SEQ ID NO: 306 - DNA, 1001 bp, Homo Sapiens
  allele 501: 12-124-58 : polymorphic base A or C
  misc_binding 481..500: 12-124-58.mis1, potential
  misc_binding 502..521: 12-124-58.mis2, potential complement
  primer_bind 444..462: upstream amplification primer
  primer_bind 940..958: downstream amplification primer, complement
  misc_binding 489..513: 12-124-58 potential probe
gccttgaataccaggcttaggggagcagtggaagaaagtggcatgtgtgaccatacatgtgttcctgcagaacatactgagttcacttgggatcagaaagcctgggaagacaagctgattcaggtaaacgggtaacaagtttgctgaggcctgggaggaggagaaagatgggagcagatggaaaggcatttggtgggctgggcacatgaggagtttagaagcccctaaaggacatgttctccttctgtcagagaagacttgggagttacaaagtctatagctgtgtccatccccaggggagaactgagagaaccttccatcccgagagccaggtggccaggagggcagcagggagtgacaccccttctgctagccgccagagccacagccattcctcagacccacagaacattattagcactggatcagggatctatggacttagtgatctggagatgtgggcaagggaagcgagagagggcaagtcagtactcaaggtcmcgtagcattcccagagcccaggcaagaacaaggatgaaggcctttggcccttctcaccaacgtcttgtgcctccccagtttctgcgaaactccctcaagaagacccgggggtctagctggagcctgcgcttgagcaaagagctgaacaaccagattgcgagctttgacagcccctctctggagaaggtttgtcttcatagggacaggagagtttggacaaggagtagactccaggggtgatggagtggagaggataacaccgtgtgtgtgagatcagctggacctgtggctgtttacagggtcctgggaggagaggagcgtggtctggattggtggttttagttttgttttggtttatttttttgctttgttttgttgatcctccagattctggctagcaatcacatgtgtgtatttctttgtaaacacaaaactataccgcattgctacaaaattctaaaacatttttgaaagaaatcagtgagggtctcaataaatag

SEQ ID NO: 307 - DNA, 1001 bp, Homo Sapiens
  allele 501: 12-126-222 : polymorphic base T or C
  misc_binding 481..500: 12-126-222.mis1, potential
  misc_binding 502..521: 12-126-222.mis2, potential complement
  primer_bind 703..722: upstream amplification primer, complement
  primer_bind 267..286: downstream amplification primer
  misc_binding 489..513: 12-126-222 potential probe
agctatgttattaggtgcataaacatttaggattgttatgtctggttgatgaactgacccttattgtgatgacatgaccctgtttatctatggtaatgtcatttgctctaaaatgaacttttatatcagaacggcctctggggccatctggagtgcagggtgggctgtgctcctggcccttcattacaggcagacatttggagccaggccaaatgcaacagccaagcaccatcctggtgagaatgctggggatgctctttccctgcctacagcctcatctcccttcatgatggggcctgtctagaaccacaaggaagcattgaaagtcgatctgagtaggagggtgaggtgggcaaaagctggccaggaaagggctggccccaggattttaacacccactttggtgttctgggctctacccatagctcctggaaaagtggatcttgtcggagaaagaatgggagcgggaaaaggccgtgagcctccatctctatctcatgyggatttatgtccacagcactgctgtctgtgtgagtccaggagtccccagcccccagcctgctgctctgacatgcacagaaaaattcctgtgtctatctggaagatgagggaacacttatgaaatcaagttctgtccccagagggccccttgggagaggctgcagtgacctagtgccctgggctgggtcagggagggagagggtgggattgtggttggcagagctccaggctttgtggggcctgtggcttctgtagcggtgagagccctttttaagaaaaaagatacatagttatgaaccccacattggctaggaaaatgaatatttactttgagaaaatcaagtgctgcaaaatcataaattttgcaaagcttgacaagtaccgcaacccttaaaatgtctagaacgacgtagtgtttttactgattgaccatctgacacagcctgatgagacttaattgtctacactttttggctccatgctgtttgactgtcttgtcc

SEQ ID NO: 308 - DNA, 1001 bp, Homo Sapiens
  allele 501: 12-126-297 : polymorphic base T or C
  misc_binding 481..500: 12-126-297.mis1, potential
  misc_binding 502..521: 12-126-297.mis2, potential complement
  primer_bind 778..797: upstream amplification primer, complement
  primer_bind 342..361: downstream amplification primer
  misc_binding 489..513: 12-126-297 potential probe
gaaatctctgactaatagtgtgaacttgtttatttctccttttggctctttcattttttgcttcatgtattatttagctatgttattaggtgcataaacatttaggattgttatgtctggttgatgaactgacccttattgtgatgacatgaccctgtttatctatggtaatgtcatttgctctaaaatgaacttttatatcagaacggcctctggggccatctggagtgcagggtgggctgtgctcctggcccttcattacaggcagacatttggagccaggccaaatgcaacagccaagcaccatcctggtgagaatgctggggatgctctttccctgcctacagcctcatctcccttcatgatggggcctgtctagaaccacaaggaagcattgaaagtcgatctgagtaggagggtgaggtgggcaaaagctggccaggaaagggctggccccaggattttaacacccactttggtgttctgggctctacccatagytcctggaaaagtggatcttgtcggagaaagaatgggagcgggaaaaggccgtgagcctccatctctatctcatgtggatttatgtccacagcactgctgtctgtgtgagtccaggagtccccagcccccagcctgctgctctgacatgcacagaaaaattcctgtgtctatctggaagatgagggaacacttatgaaatcaagttctgtccccagagggccccttgggagaggctgcagtgacctagtgccctgggctgggtcagggagggagagggtgggattgtggttggcagagctccaggctttgtggggcctgtggcttctgtagcggtgagagccctttttaagaaaaaagatacatagttatgaaccccacattggctaggaaaatgaatatttactttgagaaaatcaagtgctgcaaaatcataaattttgcaaagcttgacaagtaccgcaacccttaaaatgtctagaacgacgtagtgtttttactga

SEQ ID NO: 309 - DNA, 1001 bp, Homo Sapiens
  allele 501: 12-128-225 : polymorphic base T or G
  misc_binding 502..520: 12-128-225.mis1, complement
  misc_binding 481..500: 12-128-225.mis2, potential
  primer_bind 706..725: upstream amplification primer, complement
  primer_bind 276..295: downstream amplification primer
  misc_binding 489..513: 12-128-225 potential probe
ccctgaaatgggaccatgacagctgggtctgagagacagtggtagaaacatccagattcagcacttacttgctggcttggatgcagggtctagaacgaaaagagaagaaaagtcacttctatacagaaacatgtccagagcgcttactgtctccaaaaccatggactggcacctgagtgatagcatgattccaaagccaaaatcttgcctgtaaggaatatatatatatatatatatatatatatatgtatatatgatatagctatagtctaatagcaaggacagatatgcaaactgctaaaagatacaaggcagaacagaacaaaatgctgtttttctgggattttggaaattcaaggaattcaagggattcaaggaaggtggctttgcttcccgggagggtcctgtagatgatctacagggcactggacatgtttatgttgctcctttagtaataagcctgtcattctgatttgatgaaaggagatgaaaggagctggkagtgtgtctgatggtggcctactaacttatgtcttcagcttaaaaagaaagtagcttcaaaagggttccagaaacactttccatggacgtgtcactctttagcagcccccaaagcaagaccatcatattgctgccctgctgtgtgatttctcagcccctagagcaccatcccctgtaattgcctggtcatgagtttgtctctgtctacctgacccctcctttcaggcaaggaccatttctaacttgactttctgggcctagttcctagcatagtgactgccatccagtagggctcacacgttccataaatatttggcagatgagggaattagcaatgggttctgctttggtttcagagcagatattaattggattgcttagtagtggttctctgttgtaattcatgagcatgaatgtggattgcccactattcagattagtaagtatttcttggtcaagggcagagctgtggccacaaaccatccaggtacacagcagaa

SEQ ID NO: 310 - DNA, 1001 bp, Homo Sapiens
  allele 501: 12-129-176 : polymorphic base G or T
  misc_binding 481..500: 12-129-176.mis1, potential
  misc_binding 502..521: 12-129-176.mis2, potential complement
  primer_bind 326..344: upstream amplification primer
  primer_bind 779..797: downstream amplification primer, complement
  misc_binding 489..513: 12-129-176 potential probe
ggttgtgcatgtccttcattgggaaggagcagggacactacattgagacttgacccatctggattttttgtttgcacaattttcaggggaaagatgatgcaacagcaaattacaattgttaatgtgataatttttagtggtcctgtcttgcgaatgatagagaggtgaccacaggagacctaagcactcgcaggaagtagaagtgttaaagaggttgactcagttcagtggaagtagagcaacgaacgtgggatatatgtctgtgattatagaattacacactgagttcagtttccagagagggatctgtgctgacaaaagatttttctggtcaggatttggggtctggtgcatgatgtggggacatctcagagttcggaaggcatagttttggttgcaggtcaattgggtcttctacttggaatgctgaaattatcaagaaattgtggaagggtctagggaggagataaaactgtgagcgtataagcccagttaagctgkggacggtgatgaatggacatgtgtccaagaagggaagtgtttctcaggtgaagctgaacatatcaccaaacccaccctatcccactccaagtttctatagtgggatctacttctttaccaacaatttcaaaggcagctttctttaatccagaatatttggggttcattgatgtggtactctgggacctgaatattgtttcttattccttggtgtgccatgtatttcatgagagaattcagcctttttatgtcatattcactgaatgcatatgaacttccatgacttgatccttttgtatttttatttctgtacttctttttattaacataggtattattgccaaacactctaagcttcattttttaaaatcaaaccacatgatttttttattggtgattttctcccttatgcagtgtagttattcaattataaaatatgtgtttattagatttgtaacaatgttgaaaagtgggatggaatttaaatagtgactcttgcc

SEQ ID NO: 311 - DNA, 1001 bp, Homo Sapiens
  allele 501: 12-130-203 : polymorphic base C or T
  misc_binding 481..500: 12-130-203.mis1, potential
  misc_binding 502..521: 12-130-203.mis2, potential complement
  primer_bind 301..319: upstream amplification primer
  primer_bind 733..753: downstream amplification primer, complement
  misc_binding 489..513: 12-130-203 potential probe
  misc_feature 167: n=a, g, c or t
aatcgttctttgaaacagaacatcttctgatgaaattttctagaagaatggcaattatgaacaatatgtctttgatcatacataggtcttgtgtggagctactgcataatgaggccctgatcaggcacctgcatgctacttcctttgatgtggttctaacagacccnctttcacctctgcgcggcggtgctggctaagtacctgtcgattcctgctgtgtttttcttgaggaacattccatgtgatttagactttaagggcacacagtgtccaaacccttcctcctatattcctagattactaacgaccaattcagaccacatgacattcctgcaaagggtcaagaacatgctctaccctctggccctgtcctacctttgccatgctgtttctgctccttatgcaagccttgcctctgagctttttcagagagaggtgtcagtggtggatcttgtcagccatgcatctgtgtggctgttccgaggggactttgtgatggaytaccccaggccgatcatgcccaacatggtcttcattgggggcatcaactgtgccaacgggaagccactatctcaggtctgtattggtgcctttatccaatcaatgttccaggcaaaacactttttaaaaaatgtatttacttacaagtgcttccatatctacttatctttccaaagatttcatttctgcttctcattgttgtaatagtcttcagtgagataaacttttaaagggtcaatggtagtgcagttcagggtttcaatggccactgagaggaaggagaggcagggacgaggatctgtcaaaggatgggcaagagtggtgtgactcacggagactgttcgtttgtaaaagcaccatcttcatggctgtggatgtgcttcagctgggcaggagcagggacactacactgagaactgatccatccaatcttgctggcaagattttcagtagaaaggaggaaggaatagaaatttacaattgttgacgtgacaattttt

SEQ ID NO: 312 - DNA, 1001 bp, Homo Sapiens
  allele 501: 12-130-260 : polymorphic base C or T
  misc_binding 481..500: 12-130-260.mis1, potential
  misc_binding 502..521: 12-130-260.mis2, potential complement
  primer_bind 244..262: upstream amplification primer
  primer_bind 676..696: downstream amplification primer, complement
  misc_binding 489..513: 12-130-260 potential probe
  misc_feature 110: n=a, g, c or t
tgaacaatatgtctttgatcatacataggtcttgtgtggagctactgcataatgaggccctgatcaggcacctgcatgctacttcctttgatgtggttctaacagacccnctttcacctctgcgcggcggtgctggctaagtacctgtcgattcctgctgtgtttttcttgaggaacattccatgtgatttagactttaagggcacacagtgtccaaacccttcctcctatattcctagattactaacgaccaattcagaccacatgacattcctgcaaagggtcaagaacatgctctaccctctggccctgtcctacctttgccatgctgtttctgctccttatgcaagccttgcctctgagctttttcagagagaggtgtcagtggtggatcttgtcagccatgcatctgtgtggctgttccgaggggactttgtgatggattaccccaggccgatcatgcccaacatggtcttcattgggggcatcaactgtgccaaygggaagccactatctcaggtctgtattggtgcctttatccaatcaatgttccaggcaaaacactttttaaaaaatgtatttacttacaagtgcttccatatctacttatctttccaaagatttcatttctgcttctcattgttgtaatagtcttcagtgagataaacttttaaagggtcaatggtagtgcagttcagggtttcaatggccactgagaggaaggagaggcagggacgaggatctgtcaaaggatgggcaagagtggtgtgactcacggagactgttcgtttgtaaaagcaccatcttcatggctgtggatgtgcttcagctgggcaggagcagggacactacactgagaactgatccatccaatcttgctggcaagattttcagtagaaaggaggaaggaatagaaatttacaattgttgacgtgacaatttttagtggtcccatcttgcaaaagatagagaggtgaccacaggagacctaagcactcaga

SEQ ID NO: 313 - DNA, 1001 bp, Homo Sapiens
  allele 501: 12-131-112 : polymorphic base T or C
  misc_binding 481..500: 12-131-112.mis1, potential
  misc_binding 502..521: 12-131-112.mis2, potential complement
  primer_bind 594..612: upstream amplification primer, complement
  primer_bind 104..124: downstream amplification primer
  misc_binding 489..513: 12-131-112 potential probe
catcttgagctcagcctccctgcagctttttttatattgacagccacttcagagagagtcctctttgagctttacaagaaatatcctggtgtgaaaaacgaccaaaaccagatagccagcctccccactccctgtttaaagaaagctggcttagcaatgttgtctgcattttggatgtgctgtgttacccatatgtgggaagaaagagtattaagagttagcaaatagggtcacatccagcagagaccatatggttggggactagggcaatggtgactcctcagacctcagctgcagcctgataaacgtggttaagagagaagtaggagacagtgacatgaaatgggggttcacagccttgtgttgggaattgaatgagaaacaagagcttgaacttggatgttccccagagcgagcgcaaggtcagatgagtttttcaagataggagtgatcggtctttcccagggtggggcccataatgcaagacaattatagattaaygggtaataagtaactggaggagggcactctgtcttcaattacatgttgatttgctaggtgtctcagtgacaaggtaattaagacgaaggaaacaattctaggaggcacaacgtggggtggacagtcagctgtcggtggcttctgctgagatggccacaggactccaggttcccctgccgcagctggccacaggactgctgcttctcctcagtgtccagccctgggctgagagtgggaaggtgctggtggtgcccactgatggcagccactggctcagcatgcgggaggccttgcgggacctccatgcgagaggccaccaggtggtggtcctcaccctggaggtgaatatgtacatcaaagaagagaactttttcaccctgacaacgtatgccatttcatggacccaggacgaatttgatcgccttttgctgggtcacactcaatcgttctttgaaacagaacatcttctgatgaaattttctagaagaatggcaattatg

SEQ ID NO: 314 - DNA, 755 bp, Homo Sapiens
  allele 255: 12-132-157 : polymorphic base C or T
  misc_binding 235..254: 12-132-157.mis1, potential
  misc_binding 256..275: 12-132-157.mis2, potential complement
  primer_bind 99..117: upstream amplification primer
  primer_bind 557..577: downstream amplification primer, complement
  misc_binding 243..267: 12-132-157 potential probe
cagctccatggccaggatgtggatgtcagcgtggctggcaagagcaggcaaggtgggcaaagttcctgtccagctgattggattgggcaggtgggctgtctccttgtctgggaatgcccacccctctccacattcctcccaccctcattcccccttctcctggaaacatccaagtccaaattaatactattaatgcctacctggatattaatgcctacctgatcatatctaggtcatgttagaattgtgtaaacytcctttggatagctcactcctcatgtcctgtccccccagcccacagccctggtccagatcccatccttgggagctcctggcccagcctttcccatgcatgaccttactgggcctctgctctgcctggcttctctgagccagctagagtaactataggcatcccatcctctgtagactaccctcactgtggtccactcagagtgggcactgttaacaccaggctctcaaaacaactatgcccacctaccatgcttgctcctgtccccttccctccaactctggccccaagggcatcgctggtgatgtaggtgattgatggggtcctttaggatccagggctagcaaagggcagagcctgctctctgactttgatctaaacaagctggccagtcaatcctctgaggtcttcctcatgcccctctcactcttgactctggttgagtcctctccaggtcccctgcactggcatcttctcagcaggcctggccgtgcccttgtcc

SEQ ID NO: 315 - DNA, 991 bp, Homo Sapiens
  allele 501: 12-132-437 : polymorphic base A or C
  misc_binding 481..500: 12-132-437.mis1, potential
  misc_binding 502..521: 12-132-437.mis2, potential complement
  primer_bind 68..86: upstream amplification primer
  primer_bind 526..546: downstream amplification primer, complement
  misc_binding 489..513: 12-132-437 potential probe
tggctggcaagagcaggcaaggtgggcaaagttcctgtccagctgattggattgggcaggtgggctgtctccttgtctgggaatgcccacccctctccacattcctcccaccctcattcccccttctcctggaaacatccaagtccaaattaatactattaatgcctacctggatattaatgcctacctgatcatatctaggtcatgttagaattgtgtaaacctcctttggatagctcactcctcatgtcctgtccccccagcccacagccctggtccagatcccatccttgggagctcctggcccagcctttcccatgcatgaccttactgggcctctgctctgcctggcttctctgagccagctagagtaactataggcatcccatcctctgtagactaccctcactgtggtccactcagagtgggcactgttaacaccaggctctcaaaacaactatgcccacctaccatgcttgctcctgtccccttccctccaamtctggccccaagggcatcgctggtgatgtaggtgattgatggggtcctttaggatccagggctagcaaagggcagagcctgctctctgactttgatctaaacaagctggccagtcaatcctctgaggtcttcctcatgcccctctcactcttgactctggttgagtcctctccaggtcccctgcactggcatcttctcagcaggcctggccgtgcccttgtccatttgtttgtgcgctgttggtttgcttttcctgggctcattggctcccaaagcctgtggagagagtcaggagtgggtagaatggcagtgtctaattacttttggctcaacagaggatggggttcacagtaggagacaaaacactgtcatggaaagtcttggtgtccactacaaaatgcgcatggcctgaaaagagcatcttctaaacctcaacccattagcacgattctcccctcttcccaggataagtgaaatgtaatgatgttct

SEQ ID NO: 316 - DNA, 1001 bp, Homo Sapiens
  allele 666: 12-133-153 : polymorphic base T or C
  misc_binding 646..665: 12-133-153.mis1, potential
  misc_binding 667..686: 12-133-153.mis2, potential complement
  primer_bind 800..818: upstream amplification primer, complement
  primer_bind 250..270: downstream amplification primer
  misc_binding 654..678: 12-133-153 potential probe
ggtctgggatctaacggtgatagttctagtgaaaccctcccacccttccaggagacccattcctataagaaatatgactgaagagcccagctgtctcactttgataaccaattcttccatttgcatttccattgatgtgtattgggccaagagcagagctttttcttgtggttaatatctgtttaatccagaagaagaccctaaggaaaggtcagtatttaggtcccagagtagctctttaaaatcctttaaaggaaaagagagtatgggatagtaaagggccatgggatggatctttgaggatcaaggaacttgggacaggaggagaaaggatctgagagcctttcttccaccatctcgacatctatgttggtgtttctcaatttttaagaagctgtggatgttgagagaaccccttaaaggagttatgagagatactgatatgaatttctcattagccattaattatcagtgtgtagaagagagggcgagagggctctattaaactaaggatattatctattgctgtgtaacaaattatcataaactcagtggcttaaaagaacatccattgattatctcacggttccactggccaggagtctaggcatggctttccttggtcctttgtttagggtctcagagactgcagtcctttctggagtycagcttcctcttccaagctcatgtgcttattggagaattcagtttcttatggttgtaggactgaggccctcagttccttgctacgtggccctcaccacaggcagtttgcatcatggctgtttacttttcaaggccagtagaatgtttctgttcaatctgataagagggaatctcatgtggcatagtgtgatcatgggaatgacatcccaccatctttgccatatgatgtaatccactcgagagagggtcacccatcacctttgccatattctgttgattagaaggaagtcacaggttccacccacacaccctcaaggggatggctttatggaagg

SEQ ID NO: 317 - DNA, 1001 bp, Homo Sapiens
  allele 501: 12-133-318 : polymorphic base T or A
  misc_binding 481..500: 12-133-318.mis1, potential
  misc_binding 502..521: 12-133-318.mis2, potential complement
  primer_bind 800..818: upstream amplification primer, complement
  primer_bind 250..270: downstream amplification primer
  misc_binding 489..513: 12-133-318 potential probe
ggtctgggatctaacggtgatagttctagtgaaaccctcccacccttccaggagacccattcctataagaaatatgactgaagagcccagctgtctcactttgataaccaattcttccatttgcatttccattgatgtgtattgggccaagagcagagctttttcttgtggttaatatctgtttaatccagaagaagaccctaaggaaaggtcagtatttaggtcccagagtagctctttaaaatcctttaaaggaaaagagagtatgggatagtaaagggccatgggatggatctttgaggatcaaggaacttgggacaggaggagaaaggatctgagagcctttcttccaccatctcgacatctatgttggtgtttctcaatttttaagaagctgtggatgttgagagaaccccttaaaggagttatgagagatactgatatgaatttctcattagccattaattatcagtgtgtagaagagagggcgagagggctctwttaaactaaggatattatctattgctgtgtaacaaattatcataaactcagtggcttaaaagaacatccattgattatctcacggttccactggccaggagtctaggcatggctttccttggtcctttgtttagggtctcagagactgcagtcctttctggagttcagcttcctcttccaagctcatgtgcttattggagaattcagtttcttatggttgtaggactgaggccctcagttccttgctacgtggccctcaccacaggcagtttgcatcatggctgtttacttttcaaggccagtagaatgtttctgttcaatctgataagagggaatctcatgtggcatagtgtgatcatgggaatgacatcccaccatctttgccatatgatgtaatccactcgagagagggtcacccatcacctttgccatattctgttgattagaaggaagtcacaggttccacccacacaccctcaaggggatggctttatggaagg

SEQ ID NO: 318 - DNA, 643 bp, Homo Sapiens
  allele 249: 12-136-238 : polymorphic base A or G
  misc_binding 229..248: 12-136-238.mis1, potential
  misc_binding 250..269: 12-136-238.mis2, potential complement
  primer_bind 12..32: upstream amplification primer
  primer_bind 442..461: downstream amplification primer, complement
  misc_binding 237..261: 12-136-238 potential probe
acacagggtgagcaaaagggagactttttatccttttttgagaaagcaaccacaaaattttgaccttatgaagtatctttgaaactttccaaagctgattagaatagcgttgatgtattttaatcagatacagaaagactttacaaagtatgagctgcacacttgctgtcgtaatgcttataagcactaatttttttgtatacattcatgtacttgtaattgcacaaaatgcgaaggacacatttggcrgtgaggatgctgtgcacaatcaactcctaatcattttcaggaaaggataaacattccgctaaaaatgaggaaagacaagaaatgttcaaaagcatgtcaaaagtgtccagctgttttcatagaatataggtgatttcctggtgctagcaaaatccagaagaaacgttataataactagaaatgtctataattgtgaggaagcccaagtatgaagattcacaaaaatagaataagtggatgaaattagttaaaacaaccttcttagtaatgaggtactctgattataaaagtactttgactctttagaatgtgtcactgaacaccaagctgaaaaaacaaattaacagtctgtcactagagcatgatctcccacagacaatatgctcataaatga

SEQ ID NO: 319 - DNA, 1001 bp, Homo Sapiens
  allele 501: 12-138-141 : polymorphic base G or A
  misc_binding 481..500: 12-138-141.mis1, potential
  misc_binding 502..521: 12-138-141.mis2, potential complement
  primer_bind 623..641: upstream amplification primer, complement
  primer_bind 186..204: downstream amplification primer
  misc_binding 489..513: 12-138-141 potential probe
tgatgtgtggtactgggatacagagatgggcaagactgtgaggtgcttactccctgaggaccaattgggacctgagatgttcataatttttaaaagttcccttgtcttctgacacagtgggtttgggagccattgtcctacagcacatgagctgagttgcaaagatgttgagccagtgggcatgggagagtaaagatacaccagacacagtgtgcagggatgtttggctagtggggagatgcctagctgggttaaggggctggggtagaggatgttggagggagtgatacaaagtgcaaccaggggacctggtgggcttgtacagacaaggtttgcatcacgtggtaccagacaaggttttggactagacaagggtttggaacagagctgatccaaaccttgctgggcaccacccccagagtttctgattcagtaagtctggggtggagcctgagaatcagcatttctaacaagttcccaggtgatgccaaggctgatctrgagagcctactttgagaactgttggattttagactacccttttgtcttggagtgggtagcaaaggggtgctatgagcagaggagcttatttataaaaagttttattatttttgttggatttggatttgcatttgcgttttcccccttttatttttagttgacacataacaattgtacatatttatagaatacaaagtgatatttcaaaacatatatacaatgtgtaatgaccgaatcagggtaattagtatatccaacactgcaaacatttatcatttctttgtgttgcaagcattcaaaactgtttcttctagttttttgaaaatatacaatcaatcattgttgactatattcacaacctacagtgctatagaacacaagagcttattccttctctccagctgtaattttgtatcttttaatcaacttctccctatcctcccctgcccttagctttcctataccctaataccgaaattctactcttgacttctatgagc

SEQ ID NO: 320 - DNA, 1001 bp, Homo Sapiens
  allele 501: 12-138-42 : polymorphic base T or G
  misc_binding 481..500: 12-138-42.mis1, potential
  misc_binding 502..521: 12-138-42.mis2, potential complement
  primer_bind 524..542: upstream amplification primer, complement
  primer_bind 87..105: downstream amplification primer
  misc_binding 489..513: 12-138-42 potential probe
ccttgtcttctgacacagtgggtttgggagccattgtcctacagcacatgagctgagttgcaaagatgttgagccagtgggcatgggagagtaaagatacaccagacacagtgtgcagggatgtttggctagtggggagatgcctagctgggttaaggggctggggtagaggatgttggagggagtgatacaaagtgcaaccaggggacctggtgggcttgtacagacaaggtttgcatcacgtggtaccagacaaggttttggactagacaagggtttggaacagagctgatccaaaccttgctgggcaccacccccagagtttctgattcagtaagtctggggtggagcctgagaatcagcatttctaacaagttcccaggtgatgccaaggctgatctggagagcctactttgagaactgttggattttagactacccttttgtcttggagtgggtagcaaaggggtgctatgagcagaggagcttatttataaaaakttttattatttttgttggatttggatttgcatttgcgttttcccccttttatttttagttgacacataacaattgtacatatttatagaatacaaagtgatatttcaaaacatatatacaatgtgtaatgaccgaatcagggtaattagtatatccaacactgcaaacatttatcatttctttgtgttgcaagcattcaaaactgtttcttctagttttttgaaaatatacaatcaatcattgttgactatattcacaacctacagtgctatagaacacaagagcttattccttctctccagctgtaattttgtatcttttaatcaacttctccctatcctcccctgcccttagctttcctataccctaataccgaaattctactcttgacttctatgagctcaccatttttatagctcccatatatgagtgagaacatgtggtatttatctatctgtgcctgactcatttcacttgacataatgtcctccagttttatt

SEQ ID NO: 321 - DNA, 1001 bp, Homo Sapiens
  allele 501: 12-138-67 : polymorphic base G or A
  misc_binding 481..500: 12-138-67.mis1, potential
  misc_binding 502..521: 12-138-67.mis2, potential complement
  primer_bind 549..567: upstream amplification primer, complement
  primer_bind 112..130: downstream amplification primer
  misc_binding 489..513: 12-138-67 potential probe
agatgttcataatttttaaaagttcccttgtcttctgacacagtgggtttgggagccattgtcctacagcacatgagctgagttgcaaagatgttgagccagtgggcatgggagagtaaagatacaccagacacagtgtgcagggatgtttggctagtggggagatgcctagctgggttaaggggctggggtagaggatgttggagggagtgatacaaagtgcaaccaggggacctggtgggcttgtacagacaaggtttgcatcacgtggtaccagacaaggttttggactagacaagggtttggaacagagctgatccaaaccttgctgggcaccacccccagagtttctgattcagtaagtctggggtggagcctgagaatcagcatttctaacaagttcccaggtgatgccaaggctgatctggagagcctactttgagaactgttggattttagactacccttttgtcttggagtgggtagcaaaggggtgctatragcagaggagcttatttataaaaagttttattatttttgttggatttggatttgcatttgcgttttcccccttttatttttagttgacacataacaattgtacatatttatagaatacaaagtgatatttcaaaacatatatacaatgtgtaatgaccgaatcagggtaattagtatatccaacactgcaaacatttatcatttctttgtgttgcaagcattcaaaactgtttcttctagttttttgaaaatatacaatcaatcattgttgactatattcacaacctacagtgctatagaacacaagagcttattccttctctccagctgtaattttgtatcttttaatcaacttctccctatcctcccctgcccttagctttcctataccctaataccgaaattctactcttgacttctatgagctcaccatttttatagctcccatatatgagtgagaacatgtggtatttatctatctgtgcctgactcatttcact

SEQ ID NO: 322 - DNA, 663 bp, Homo Sapiens
  allele 501: 12-139-380 : polymorphic base A or G
  misc_binding 481..500: 12-139-380.mis1, potential
  misc_binding 502..520: 12-139-380.mis2, complement
  primer_bind 122..139: upstream amplification primer
  primer_bind 602..620: downstream amplification primer, complement
  misc_binding 489..513: 12-139-380 potential probe
  misc_feature 655,658: n=a, g, c or t
caagtctgacacctgtgtggcaggccagcaggctggagactagcaggggcggatgctgcagccttgtggctgaatatcttcttcctcagagaaatcccagcgtttcactcttaaggcgtttcacccacctatgttattgaggataatctcttttatggattatgcactttcgtcacacctacaagctaccttcacaacaacacctagattggtgtttgactgaatgactaggtacagtcgcctagccaagttgacacacaaaactgaccgtcataccaggcatgcacaactggatcatctgcccggggtgcccctctagaggacttgggatcagagggagggccctggatgagaagggtttgatgagtgtgggtttgtatgaggctggcagtgataggagttgggcaacagggatgctggccccagcagggactagcagactctcttgccacatcagggtgggtgacacttaaatgcccctgacaaagactggatttggcrgtggagccagttcagggctgagactgtcaggggacatctctggggaagcagggatgggatggcaccatggcagagcctgactgttctccttagaagcccagggcttgggctaattctgagcccctttctctcccacccctaccccagcagtttngcntgagg

SEQ ID NO: 323 - DNA, 951 bp, Homo Sapiens
  allele 501: 12-140-134 : polymorphic base G or T
  misc_binding 481..500: 12-140-134.mis1, potential
  misc_binding 502..520: 12-140-134.mis2, complement
  primer_bind 368..386: upstream amplification primer
  primer_bind 868..888: downstream amplification primer, complement
  misc_binding 489..513: 12-140-134 potential probe
  misc_feature 923: n=a, g, c or t
ctgtagatcattctggctaaataatgggattcacttttaagtgaaggaggccttgaatgccacactcaggggcctagcgcagcacttcccaagccttgctgtggttaggaacaacctgggggctgggtgaaatgcaggcttggattcagcaggaccggggtagggcctgagagtctgcatttctaatcagctcccagggaatgctggtgctcagtgggtcagtgggcccctgagtagcgagggtctagagtttgaccttgagttggtagaaggtcacctgccaccatttgccaatccactgcaggtcttgaggcagatcctggaactgtcagtcaccaccaacacccctgtcccccaaatgcagctacacaccattttcacagaactgcacgtccaggtgaggccagcaagctcagctggacaagggcattctctgggtggatcagcaggaagctggcggcgggaggtggcctggcccacaactcactcgcgtgcttcctktatcctgatggggtatgaggctgtggtgcccatgcagccccaggtatggtcagctgggctgcccctgcacctgtgtccctgtgatctcctccagcctcactgcacgtcccttaccaggtgtgcaacaaggccccggcccagcatcagtacagcagccagaatctgatggagatggtgcactgcttcgtagccctcggtgaggctctgcggcagggtgctccctgcctgccccgaggcctgcaggaggcctctaggagtcccggcccctctgagcgctgggcctgggactgccttgctgggcctgctctggacccggtgagcatgactaaagctgtccttccaccctgcagctcgctcctaccccaaggagctgatgaagttcttcttcagccagatggagacaaacaaggaggccgtccgcntggggactctgaatctgattagggctat

SEQ ID NO: 324 - DNA, 756 bp, Homo Sapiens
  allele 501: 12-140-329 : polymorphic base C or T
  misc_binding 481..500: 12-140-329.mis1, potential
  misc_binding 502..521: 12-140-329.mis2, potential complement
  primer_bind 173..191: upstream amplification primer
  primer_bind 673..693: downstream amplification primer, complement
  misc_binding 489..513: 12-140-329 potential probe
  misc_feature 728: n=a, g, c or t
agggaatgctggtgctcagtgggtcagtgggcccctgagtagcgagggtctagagtttgaccttgagttggtagaaggtcacctgccaccatttgccaatccactgcaggtcttgaggcagatcctggaactgtcagtcaccaccaacacccctgtcccccaaatgcagctacacaccattttcacagaactgcacgtccaggtgaggccagcaagctcagctggacaagggcattctctgggtggatcagcaggaagctggcggcgggaggtggcctggcccacaactcactcgcgtgcttcctttatcctgatggggtatgaggctgtggtgcccatgcagccccaggtatggtcagctgggctgcccctgcacctgtgtccctgtgatctcctccagcctcactgcacgtcccttaccaggtgtgcaacaaggccccggcccagcatcagtacagcagccagaatctgatggagatggtgcactgcttcgtagccctyggtgaggctctgcggcagggtgctccctgcctgccccgaggcctgcaggaggcctctaggagtcccggcccctctgagcgctgggcctgggactgccttgctgggcctgctctggacccggtgagcatgactaaagctgtccttccaccctgcagctcgctcctaccccaaggagctgatgaagttcttcttcagccagatggagacaaacaaggaggccgtccgcntggggactctgaatctgattagggctat

SEQ ID NO: 325 - DNA, 700 bp, Homo Sapiens
  allele 501: 12-140-385 : polymorphic base G or C
  misc_binding 481..500: 12-140-385.mis1, potential
  misc_binding 502..521: 12-140-385.mis2, potential complement
  primer_bind 117..135: upstream amplification primer
  primer_bind 617..637: downstream amplification primer, complement
  misc_binding 489..513: 12-140-385 potential probe
  misc_feature 672: n=a, g, c or t
ttgaccttgagttggtagaaggtcacctgccaccatttgccaatccactgcaggtcttgaggcagatcctggaactgtcagtcaccaccaacacccctgtcccccaaatgcagctacacaccattttcacagaactgcacgtccaggtgaggccagcaagctcagctggacaagggcattctctgggtggatcagcaggaagctggcggcgggaggtggcctggcccacaactcactcgcgtgcttcctttatcctgatggggtatgaggctgtggtgcccatgcagccccaggtatggtcagctgggctgcccctgcacctgtgtccctgtgatctcctccagcctcactgcacgtcccttaccaggtgtgcaacaaggccccggcccagcatcagtacagcagccagaatctgatggagatggtgcactgcttcgtagccctcggtgaggctctgcggcagggtgctccctgcctgccccgaggcctgcaggaggcctstaggagtcccggcccctctgagcgctgggcctgggactgccttgctgggcctgctctggacccggtgagcatgactaaagctgtccttccaccctgcagctcgctcctaccccaaggagctgatgaagttcttcttcagccagatggagacaaacaaggaggccgtccgcntggggactctgaatctgattagggctat

SEQ ID NO: 326 - DNA, 1001 bp, Homo Sapiens
  allele 501: 12-141-159 : polymorphic base T or C
  misc_binding 502..521: 12-141-159.mis1, potential complement
  misc_binding 482..500: 12-141-159.mis2
  primer_bind 640..658: upstream amplification primer, complement
  primer_bind 181..200: downstream amplification primer
  misc_binding 489..513: 12-141-159 potential probe
gggagtgctgccgccatcatggtcaccaaaagccaccaccccctgcttgtgttggacaggcggtcatcaaggcagaaccgactgacaacctggtttctccagtgcgagccttggcgatggaggccctctcgcacctgaggtgagctgggttcccaccctcaccccatcccaaggggtagggaaaagttcaagaccattcctcggtgctccttcaggggttgtgcctcctttttcctctcctccctctgtagcaggggtctcacttggcggctccccagggcaatgggccagcctagatgatgggggtcggcctcagccactcttttctataattctcagccagatttcaagttgggtgcttctccttggatttatggcacatgggtgggctgctcttccattgattggggatattttgagcaaaataacagtgataacactgaagagcattgcaagcatccttcaagatgagtcaggctcagtgagtgagttgaagggctyagtcaactatttgttgataccactggtacaaaatgatctaaagcccaagacttaccttcctggagatgccaatccattggtggggagggggaaaggggaagaagttatggatttataaaattagtatttaaagagtttgggtcatctctaagaatacctcccctataggggaagattcattacttaggcgcatagcagaactatctgttactttaagctgcatcaaacaggcagattttaaaataaatgtcatgaacatcaactaagcacaatgatatgctgagtactgaagggacacagagatacataagacctagtcccagccttttaaggacttagagataagacagacacatacaaacaggattataggtcaaagctgactaacaggactgtgtttacaggtaaacccacacacacatcagcaaaaaaatatctgagaacaaaaaaaaaggggctactaacaaaagcaactcagtttatacaaaaggagctatcaa

SEQ ID NO: 327 - DNA, 1001 bp, Homo Sapiens
  allele 501: 12-141-392 : polymorphic base C or A
  misc_binding 481..500: 12-141-392.mis1, potential
  misc_binding 502..521: 12-141-392.mis2, potential complement
  primer_bind 873..891: upstream amplification primer, complement
  primer_bind 414..433: downstream amplification primer
  misc_binding 489..513: 12-141-392 potential probe
ggtcttgttttacagagaaggggacttgggctcaggcagaggaagtgctggcccaggggcacacagcaagtagatgagcagcgcgagctgggagcccaggcccactttgggccctgctcccactctgctgcctcccctaagatgccaaaagccaaatggccctaaaaagaatgaaagagatgtggggtgttagacactttgggaagtgccaggtcttcctcatgctaacactggggagtgctgccgccatcatggtcaccaaaagccaccaccccctgcttgtgttggacaggcggtcatcaaggcagaaccgactgacaacctggtttctccagtgcgagccttggcgatggaggccctctcgcacctgaggtgagctgggttcccaccctcaccccatcccaaggggtagggaaaagttcaagaccattcctcggtgctccttcaggggttgtgcctcctttttcctctcctccctctgtagcaggggtctcacttggmggctccccagggcaatgggccagcctagatgatgggggtcggcctcagccactcttttctataattctcagccagatttcaagttgggtgcttctccttggatttatggcacatgggtgggctgctcttccattgattggggatattttgagcaaaataacagtgataacactgaagagcattgcaagcatccttcaagatgagtcaggctcagtgagtgagttgaagggctcagtcaactatttgttgataccactggtacaaaatgatctaaagcccaagacttaccttcctggagatgccaatccattggtggggagggggaaaggggaagaagttatggatttataaaattagtatttaaagagtttgggtcatctctaagaatacctcccctataggggaagattcattacttaggcgcatagcagaactatctgttactttaagctgcatcaaacaggcagattttaaaataaatgtcatgaacatcaactaag

SEQ ID NO: 328 - DNA, 1001 bp, Homo Sapiens
  allele 501: 12-142-315 : polymorphic base A or G
  misc_binding 481..500: 12-142-315.mis1, potential
  misc_binding 502..521: 12-142-315.mis2, potential complement
  primer_bind 187..205: upstream amplification primer
  primer_bind 637..657: downstream amplification primer, complement
  misc_binding 489..513: 12-142-315 potential probe
tggcagtggtgtgcaagagaatgagaaccttttattcgaacccttcctgctcagagcagatatgagggcagagagaggaggggctcgcccccagggccacacagggtctagagtaggccagggatgggagttacttctggggtcctagtcactccggagccgccctcactctagtcccctttgtaaaaaggagatagacattgactgattcactgacaacctcaaccaagtccccaggaagaggagggagaaacccagagatgttacgacatctttccggggttatcttgccaccagggtccaggcaccgatgtggccctgcccagctcttggcaaacgtcaggcaggggtggggccgcctccacgacctggcactgtctctcctctgcaggctgtgcatgcagcacgtggagggccacaggcagaggctggccgagctggtgctcaggggcatggactcagaagtcctgagctgccgcatcagcagcacagcggtctgcrtggaagtgaggcaccgggtgtgggcggggtgcaagcggaggggatggggtccctggattcttctggggatggcttgtctccaaggcatgggagtcggggggacaggcgagcgcccctcctctgagtgctcattctctcatctgctccttcattcattcatcacatgagtagtgcagggcaggccctgctggaaagacaggctgagccctgcagcattgcagttaactgatgtgtgacccaggcaagtacagtgacccaggggacccagggagggcacctgggttctcgctggggcaggcttcctgcaggaggactcagagaggccgaggggctttgctaggtgggaaggcagggcccagcgaccctatctcagagtgagtgttggagcgtcctgagggcaatgatgcccaatgcaccctaggaaccaaccacagcccaggccagaggccggccagtgttttctgtaaaggactgcagagtaaatttttggctttgtggcc

SEQ ID NO: 329 - DNA, 1001 bp, Homo Sapiens
  allele 501: 12-142-321 : polymorphic base A or G
  misc_binding 481..500: 12-142-321.mis1, potential
  misc_binding 502..520: 12-142-321.mis2, complement
  primer_bind 181..199: upstream amplification primer
  primer_bind 631..651: downstream amplification primer, complement
  misc_binding 489..513: 12-142-321 potential probe
tggtgtgcaagagaatgagaaccttttattcgaacccttcctgctcagagcagatatgagggcagagagaggaggggctcgcccccagggccacacagggtctagagtaggccagggatgggagttacttctggggtcctagtcactccggagccgccctcactctagtcccctttgtaaaaaggagatagacattgactgattcactgacaacctcaaccaagtccccaggaagaggagggagaaacccagagatgttacgacatctttccggggttatcttgccaccagggtccaggcaccgatgtggccctgcccagctcttggcaaacgtcaggcaggggtggggccgcctccacgacctggcactgtctctcctctgcaggctgtgcatgcagcacgtggagggccacaggcagaggctggccgagctggtgctcaggggcatggactcagaagtcctgagctgccgcatcagcagcacagcggtctgcatggaartgaggcaccgggtgtgggcggggtgcaagcggaggggatggggtccctggattcttctggggatggcttgtctccaaggcatgggagtcggggggacaggcgagcgcccctcctctgagtgctcattctctcatctgctccttcattcattcatcacatgagtagtgcagggcaggccctgctggaaagacaggctgagccctgcagcattgcagttaactgatgtgtgacccaggcaagtacagtgacccaggggacccagggagggcacctgggttctcgctggggcaggcttcctgcaggaggactcagagaggccgaggggctttgctaggtgggaaggcagggcccagcgaccctatctcagagtgagtgttggagcgtcctgagggcaatgatgcccaatgcaccctaggaaccaaccacagcccaggccagaggccggccagtgttttctgtaaaggactgcagagtaaatttttggctttgtggccaactca

SEQ ID NO: 330 - DNA, 1001 bp, Homo Sapiens
  allele 501: 12-143-453 : polymorphic base A or G
  misc_binding 481..500: 12-143-453.mis1, potential
  misc_binding 502..520: 12-143-453.mis2, complement
  primer_bind 50..68: upstream amplification primer
  primer_bind 533..552: downstream amplification primer, complement
  misc_binding 489..513: 12-143-453 potential probe
gcccaggatgagtatcagggccatctacctggctatccgggtagtcaagaacaccatctctgatacccggtccaaggtaacagggcagagacctggaaatggggggcactcaggggaccctgccagggaggcaaagggaagtctgggctctgggaggcagaggcttttgatggaaaacccggctttccatcgggtctcgactggggctgcagaatggtgaggccagtgaaagctgaggttccactctcgagacctcattctctccatggatctagagtttttgagtggtgtgtctcaggcaccaccttggacccaacagaggccgagtaaatccagctgcagctagagtcacttggctgtcaagggttttgtgaggtctttatcgcatgtgaaaaaagcaactaaggggtactcctctacccatcctcaaaaggctgaaaaccacagtcccaggctccatggcagccacatccaccttggagtggagcttggttctggccrtgggctggggaagggaggtccggcatagtgaggggtctgcacagcagttttgaggaacatcagagagggaatggaggagaatgggggctagagatttaggcagagctgtcttcagtccctggaggctgtggagggaagcgagaagaggctcgttctgcatctccttcacatagtgattctcatcaatggagcaagccccagggggtccaggataacagatgggctccccatggcaagggctgctagaatggagcagccgaggttggaagggagggagggagctttgtgtctctccaaggctcaattaggctcccaggtgggcatgctgcagagtgggacccctggatgaggcagggggaggtggacagagtgggcagtaatcaggtagtccctgaggccccttctagcccagagcacccccaattcctagctctctatgtcacaggattgggtgccttggagcccaccccaacccccagcatgtccacggtcctgtcccc

SEQ ID NO: 331 - DNA, 1001 bp, Homo Sapiens
  allele 501: 12-144-169 : polymorphic base G or A
  misc_binding 481..500: 12-144-169.mis1, potential
  misc_binding 502..521: 12-144-169.mis2, potential complement
  primer_bind 651..669: upstream amplification primer, complement
  primer_bind 148..167: downstream amplification primer
  misc_binding 489..513: 12-144-169 potential probe
cctgacctcgtgatccgcccaccttggcctcccaaagtgctgggattacaggcgtgagacaccgtgcccttctagctcactttttaatgcttttctgactcctggactatttcctgggccccagccaggacagagggctaagccagctctggactgttaggggttggaggtggagggcagcagggttgtcctctctgccttctctctgctcacccccagccccaacttcctgtaatcatccctcacaacctcacagtgtttgagttcatgccatacatgggcatcaccctggctaccatattcaccatgctgagacttgccaatgaagccaagatacgccaggcgatctgcagtggtgagtgtcccacttgagcctgcaggtctggctcgatcagggcgccggagggagactgctgggtaaggagcagatggaggggttgttgaaaaagaggtgcactgttcacttgttctccaaaggcgtttgcttaatcttttacttcrtgtggcctctgattggctgcctggggcacaagaggctgagacatggtgggggccttttagaagatcccggcttagagggaagaagctgcaacggtgactccatttagcttgctttgtaattaagcacttcagttcatgagaccacagaacagcaatgagcattcacaggagagggagaccggggaaaacggctccatgtggagcttgacggggactggtcttagatgctatttcaatctgatcaccttgccccagattttgattacttaatgttcttgtgggcttataaaaagccctagtgcctgagaaaaagagggccacatgtgttcactgttcactgccctctgacctggaatccccaggatgtgggcagggtcatactccaggcctcgcccttgaccccgtctctgtccttgaaggagagggacccagacacccccgagtgctcagttctcacacacacaggcacgcagagtaaaaatgaaggtgctgtggggggt

SEQ ID NO: 332 - DNA, 1001 bp, Homo Sapiens
  allele 501: 12-144-33 : polymorphic base G or A
  misc_binding 481..500: 12-144-33.mis1, potential
  misc_binding 502..521: 12-144-33.mis2, potential complement
  primer_bind 515..533: upstream amplification primer, complement
  primer_bind 12..31: downstream amplification primer
  misc_binding 489..513: 12-144-33 potential probe
gctaagccagctctggactgttaggggttggaggtggagggcagcagggttgtcctctctgccttctctctgctcacccccagccccaacttcctgtaatcatccctcacaacctcacagtgtttgagttcatgccatacatgggcatcaccctggctaccatattcaccatgctgagacttgccaatgaagccaagatacgccaggcgatctgcagtggtgagtgtcccacttgagcctgcaggtctggctcgatcagggcgccggagggagactgctgggtaaggagcagatggaggggttgttgaaaaagaggtgcactgttcacttgttctccaaaggcgtttgcttaatcttttacttcgtgtggcctctgattggctgcctggggcacaagaggctgagacatggtgggggccttttagaagatcccggcttagagggaagaagctgcaacggtgactccatttagcttgctttgtaattaagcacttcagttcrtgagaccacagaacagcaatgagcattcacaggagagggagaccggggaaaacggctccatgtggagcttgacggggactggtcttagatgctatttcaatctgatcaccttgccccagattttgattacttaatgttcttgtgggcttataaaaagccctagtgcctgagaaaaagagggccacatgtgttcactgttcactgccctctgacctggaatccccaggatgtgggcagggtcatactccaggcctcgcccttgaccccgtctctgtccttgaaggagagggacccagacacccccgagtgctcagttctcacacacacaggcacgcagagtaaaaatgaaggtgctgtggggggttggaagggcagggtgcagcctgctcgctacggcaaggcatgagcacttccactcgggaagctgggctgggaaggcttggttctgcttccagcccctctggcgccaagtgcattcccctgttgctgttggtagccat

SEQ ID NO: 333 - DNA, 1001 bp, Homo Sapiens
  allele 501: 12-146-174 : polymorphic base T or C
  misc_binding 481..500: 12-146-174.mis1, potential
  misc_binding 502..521: 12-146-174.mis2, potential complement
  primer_bind 655..674: upstream amplification primer, complement
  primer_bind 271..291: downstream amplification primer
  misc_binding 489..513: 12-146-174 potential probe
tttcttgactgctaaaacaaccagggagatcctctcagacaaaaggaaatacagcactatttactgtatcgaaaccattaagacttgcaggccgtgtgtatagcactggggataaacgtgggatgcagtgattatttccactagaactgctatatcatgaccatgaattttgggggaatttttttgagatctgagttctcttcacctccttattctctttttgacactggattcttttctttgataaattgtgaggcaatacactagtaaaggtcactcagttctaaggggaaaatgattaaccaaagaacattctaagatttcctatagggtattaggtctaatggggatgtgttatgtcaccagaacaaacttctaagtttatatagcctctagtgacataacctgagacccggacttggcacttggtaagcacacaatgaacagtcatagaaagctggccgagggtagagttcagtgtgaacaaagcaatttgggaayatcaaagcaagtttggagaacaacaagtgatccagaatggctggagggtaagaggcagagggagggggcaagcagaaggggtggagaggaggaatgagcttagacaggggggctggggtctatcccagagttttgagagcaaggcagaggactctgaattttcttctgtgcccaggaagctgctgaccaaggttccagaagtgttggtggggtggcgtttttcagggagcagctgaggcagtgattcagaagggacagctgggggttgggcaactgggggacaggggccctgaaatgggaccatgacagctgggtctgagagacagtggtagaaacatccagattcagcacttacttgctggcttggatgcagggtctagaacgaaaagagaagaggagtcacttctatacagaaacatgtccagagtgcttactgtctgcaaaactgtggactggcacctgagtgatagcatgattccaaagccaaaatcttgcctgta

SEQ ID NO: 334 - DNA, 1001 bp, Homo Sapiens
  allele 501: 12-146-47 : polymorphic base G or A
  misc_binding 481..500: 12-146-47.mis1, potential
  misc_binding 502..521: 12-146-47.mis2, potential complement
  primer_bind 528..547: upstream amplification primer, complement
  primer_bind 144..164: downstream amplification primer
  misc_binding 489..513: 12-146-47 potential probe
gtgattatttccactagaactgctatatcatgaccatgaattttgggggaatttttttgagatctgagttctcttcacctccttattctctttttgacactggattcttttctttgataaattgtgaggcaatacactagtaaaggtcactcagttctaaggggaaaatgattaaccaaagaacattctaagatttcctatagggtattaggtctaatggggatgtgttatgtcaccagaacaaacttctaagtttatatagcctctagtgacataacctgagacccggacttggcacttggtaagcacacaatgaacagtcatagaaagctggccgagggtagagttcagtgtgaacaaagcaatttgggaacatcaaagcaagtttggagaacaacaagtgatccagaatggctggagggtaagaggcagagggagggggcaagcagaaggggtggagaggaggaatgagcttagacaggggggctggggtctatcccrgagttttgagagcaaggcagaggactctgaattttcttctgtgcccaggaagctgctgaccaaggttccagaagtgttggtggggtggcgtttttcagggagcagctgaggcagtgattcagaagggacagctgggggttgggcaactgggggacaggggccctgaaatgggaccatgacagctgggtctgagagacagtggtagaaacatccagattcagcacttacttgctggcttggatgcagggtctagaacgaaaagagaagaggagtcacttctatacagaaacatgtccagagtgcttactgtctgcaaaactgtggactggcacctgagtgatagcatgattccaaagccaaaatcttgcctgtaaggaatatatgtataggatatagctatactctaatagcaaggacagatatgcaaactgctaaaagatacaaggcagaacagaacaaaacgctgtggggattcaaggaaggtggctttgtttcccttg

SEQ ID NO: 335 - DNA, 1001 bp, Homo Sapiens
  allele 501: 12-148-283 : polymorphic base G or A
  misc_binding 481..500: 12-148-283.mis1, potential
  misc_binding 502..521: 12-148-283.mis2, potential complement
  primer_bind 765..783: upstream amplification primer, complement
  primer_bind 375..395: downstream amplification primer
  misc_binding 489..513: 12-148-283 potential probe
gggtctctcctttagaaaggcacatatttaattctccatcttgaaatttggactagggcccccacaaattgtgcagcccattctgttctggaggaaccattcttatcagaacttggtgctggattgacttggagaagagcctgaccataatcttcaggatgaaataaaggcctggatgactgaaataaagactggagccttcggcattcagaagaggaattcagactgtgcaagatctgaggccaggctccagctcccccagtcccttggtgagcaggagctccctgaacccaccatgggtctttgctagggttgtcttgcccatgtgtgctttagatagcagcacctcttcttccatggtgtatatggagaatcctcaacaaagtcttcccaagaatctgatcatcacatcttgagctcagcctccctgcagctttttctatattgacagccacttcagagagagtcctctctgatccttacaagaaatatcctggtgcraaaaacgaccaaaaccacatagccagcctccacgctgttcagagaaagctggcttagcaatgttgtatggtttttggatgcgctgcgttactcatacatgagaagaaagtttcaagggttagcaaatagggtcacatccagcagagagcatatgactgggggctagggcaatggtgactcctcagacctcagctgctgcctgataaacatggttaacagagaagtaggagacagtgacatgaaatgggtgttcacagccttgtgttgggaattggatgagaaacaagagcttgaacttggatgttccccagagtgagcacagggtcagacgtgtttttcaagatagtcatgatcggtcttttccagggtggggcccacagtgaaaaacagtgatagattaatggttaataattaactagaggagggcactctgtcttccaattacacgttgatttgctaagtggctcagtgacaaggtaattaagatgaagaaagcaaat

SEQ ID NO: 336 - DNA, 1001 bp, Homo Sapiens
  allele 501: 12-148-311 : polymorphic base T or C
  misc_binding 502..520: 12-148-311.mis1, complement
  misc_binding 481..500: 12-148-311.mis2, potential
  primer_bind 793..811: upstream amplification primer, complement
  primer_bind 403..423: downstream amplification primer
  misc_binding 489..513: 12-148-311 potential probe
ttgggcttgaggcccttgtgagtgctcagggtctctcctttagaaaggcacatatttaattctccatcttgaaatttggactagggcccccacaaattgtgcagcccattctgttctggaggaaccattcttatcagaacttggtgctggattgacttggagaagagcctgaccataatcttcaggatgaaataaaggcctggatgactgaaataaagactggagccttcggcattcagaagaggaattcagactgtgcaagatctgaggccaggctccagctcccccagtcccttggtgagcaggagctccctgaacccaccatgggtctttgctagggttgtcttgcccatgtgtgctttagatagcagcacctcttcttccatggtgtatatggagaatcctcaacaaagtcttcccaagaatctgatcatcacatcttgagctcagcctccctgcagctttttctatattgacagccacttcagagagagtcctctytgatccttacaagaaatatcctggtgcgaaaaacgaccaaaaccacatagccagcctccacgctgttcagagaaagctggcttagcaatgttgtatggtttttggatgcgctgcgttactcatacatgagaagaaagtttcaagggttagcaaatagggtcacatccagcagagagcatatgactgggggctagggcaatggtgactcctcagacctcagctgctgcctgataaacatggttaacagagaagtaggagacagtgacatgaaatgggtgttcacagccttgtgttgggaattggatgagaaacaagagcttgaacttggatgttccccagagtgagcacagggtcagacgtgtttttcaagatagtcatgatcggtcttttccagggtggggcccacagtgaaaaacagtgatagattaatggttaataattaactagaggagggcactctgtcttccaattacacgttgatttgctaagtggctcagtga

SEQ ID NO: 337 - DNA, 1001 bp, Homo Sapiens
  allele 501: 12-149-320 : polymorphic base T or C
  misc_binding 481..500: 12-149-320.mis1, potential
  misc_binding 502..521: 12-149-320.mis2, potential complement
  primer_bind 800..820: upstream amplification primer, complement
  primer_bind 368..387: downstream amplification primer
  misc_binding 489..513: 12-149-320 potential probe
cagcacctgtaattccagctaattgggaggctgaggcaggagaattgcttgaaccggggtcagggggttcggaggtcggaggttgcagtgagtccggatcatgccactgcattccagcctgggtgacacagccagactctgtctcaaaaacaacaacaacaacaaaacaacaacaacaacaacaacaaaaatctcactggacatcctagtagctaaggctttccacatattcatgattacttctgttggaaagtgctttacaacaaattgctagttgtctcagtctgggttcccctgagatgaggattcaagggccaggagtttatttaggaagtaaaggaaacactgatagaggagtggcagagtgagaaggggtgatggtcatccacagctggctctcttgtggtcaatcggagcttaatcctgctgggtgactctgggagccagtggagaaaagacaccccagacttatcccaatgaggaacacggctgttgggtgcytgagtacttgcctcgtcagggattgaaacgtactcccaggtagtagtaatttctctgcccttccattaggccacaaagggggctctgacagagagagctgacgagaaaaaacacacgcccttgtcactgaagaggtacacaggggatctgtgtggggcaccacctgcactgctaccctggacaaatagcttaagaaatccccacactgcatccccaaacttactatcagcgtgtgagggagacaggttcccacaccctcattagcacaaagtactatcttgaaaaagaaagcctgtcagtttgataggagaaaagcaggatcttgtttacaatgtgcttttattattgttattattagagattgtatttcttttcaagctgatgagccgtctgtgtttattttttggaggataccctttgcccactttcctattggagtgtattaccctgaggatttggtaagagtgcttattgcattcaccagaatgtcctttttgtca

SEQ ID NO: 338 - DNA, 1001 bp, Homo Sapiens
  allele 501: 12-151-174 : polymorphic base G or T
  misc_binding 481..500: 12-151-174.mis1, potential
  misc_binding 502..521: 12-151-174.mis2, potential complement
  primer_bind 328..345: upstream amplification primer
  primer_bind 827..845: downstream amplification primer, complement
  misc_binding 489..513: 12-151-174 potential probe
gcctgctgctctgacatgcacagaaaaattcctgtgtctatctggaagatgagggaacacttatgaaatcaagttctgtccccagagggccccttgggagaggctgcagtgacctagtgccctgggctgggtcagggagggagagggtgggattgtggttggcagagctccaggctttgtggggcctgtggcttctgtagcggtgagagccctttttaagaaaaaagatacatagttatgaaccccacattggctaggaaaatgaatatttactttgagaaaatcaagtgctgcaaaatcataaattttgcaaagcttgacaagtaccgcaacccttaaaatgtctagaacgacgtagtgtttttactgattgaccatctgacacagcctgatgagacttaattgtctacactttttggctccatgctgtttgactgtcttgtcctcaggatggctgtggcaggaggatgatggagtcagggtctggggcgcagggatggkcgtctggtgcagggagagaagtgggctgggcaggaggaccctggtcctgggcacctggatggaggtggggatgaaggctcagcaaaatgaggcaggggccaagtccaacactcagtaacatgtgaggccagaggctgtgtggaaggcttcacctgggctctcatgacattccctgcaagaggaggtgccatcatcatctccactgtgcagacaggaaacatgagactgagaggcagagtaccctgcctggactgctcagctagtgagcaggaagctctgatttgatccccagggttcgttacaggaacaactgggcccaagttcagagctgtgaactgagcagagctgagtcagagggagtcctgatccagggcccacagatccaggctgctcagcctccaggggcccagctgtgggcaggggaggctgatgcttggacaggggacagacagtggcaccctccccttccccaaatgggtgtttcagagcagggtttgccc

SEQ ID NO: 339 - DNA, 1001 bp, Homo Sapiens
  allele 501: 12-151-196 : polymorphic base C or T
  misc_binding 481..500: 12-151-196.mis1, potential
  misc_binding 502..521: 12-151-196.mis2, potential complement
  primer_bind 306..323: upstream amplification primer
  primer_bind 805..823: downstream amplification primer, complement
  misc_binding 489..513: 12-151-196 potential probe
gaaaaattcctgtgtctatctggaagatgagggaacacttatgaaatcaagttctgtccccagagggccccttgggagaggctgcagtgacctagtgccctgggctgggtcagggagggagagggtgggattgtggttggcagagctccaggctttgtggggcctgtggcttctgtagcggtgagagccctttttaagaaaaaagatacatagttatgaaccccacattggctaggaaaatgaatatttactttgagaaaatcaagtgctgcaaaatcataaattttgcaaagcttgacaagtaccgcaacccttaaaatgtctagaacgacgtagtgtttttactgattgaccatctgacacagcctgatgagacttaattgtctacactttttggctccatgctgtttgactgtcttgtcctcaggatggctgtggcaggaggatgatggagtcagggtctggggcgcagggatgggcgtctggtgcagggagagaagygggctgggcaggaggaccctggtcctgggcacctggatggaggtggggatgaaggctcagcaaaatgaggcaggggccaagtccaacactcagtaacatgtgaggccagaggctgtgtggaaggcttcacctgggctctcatgacattccctgcaagaggaggtgccatcatcatctccactgtgcagacaggaaacatgagactgagaggcagagtaccctgcctggactgctcagctagtgagcaggaagctctgatttgatccccagggttcgttacaggaacaactgggcccaagttcagagctgtgaactgagcagagctgagtcagagggagtcctgatccagggcccacagatccaggctgctcagcctccaggggcccagctgtgggcaggggaggctgatgcttggacaggggacagacagtggcaccctccccttccccaaatgggtgtttcagagcagggtttgccctatcaagttgtcctttacactg

SEQ ID NO: 340 - DNA, 1001 bp, Homo Sapiens
  allele 501: 12-151-270 : polymorphic base A or G
  misc_binding 481..500: 12-151-270.mis1, potential
  misc_binding 502..521: 12-151-270.mis2, potential complement
  primer_bind 232..249: upstream amplification primer
  primer_bind 731..749: downstream amplification primer, complement
  misc_binding 489..513: 12-151-270 potential probe
ggagaggctgcagtgacctagtgccctgggctgggtcagggagggagagggtgggattgtggttggcagagctccaggctttgtggggcctgtggcttctgtagcggtgagagccctttttaagaaaaaagatacatagttatgaaccccacattggctaggaaaatgaatatttactttgagaaaatcaagtgctgcaaaatcataaattttgcaaagcttgacaagtaccgcaacccttaaaatgtctagaacgacgtagtgtttttactgattgaccatctgacacagcctgatgagacttaattgtctacactttttggctccatgctgtttgactgtcttgtcctcaggatggctgtggcaggaggatgatggagtcagggtctggggcgcagggatgggcgtctggtgcagggagagaagtgggctgggcaggaggaccctggtcctgggcacctggatggaggtggggatgaaggctcagcaaaatgaggcagrggccaagtccaacactcagtaacatgtgaggccagaggctgtgtggaaggcttcacctgggctctcatgacattccctgcaagaggaggtgccatcatcatctccactgtgcagacaggaaacatgagactgagaggcagagtaccctgcctggactgctcagctagtgagcaggaagctctgatttgatccccagggttcgttacaggaacaactgggcccaagttcagagctgtgaactgagcagagctgagtcagagggagtcctgatccagggcccacagatccaggctgctcagcctccaggggcccagctgtgggcaggggaggctgatgcttggacaggggacagacagtggcaccctccccttccccaaatgggtgtttcagagcagggtttgccctatcaagttgtcctttacactgcccctgggcagccccaggtgtgcatgagagcacagaggtgtgagccccacggtctcctgtccctcagatccacc

SEQ ID NO: 341 - DNA, 1001 bp, Homo Sapiens
  allele 501: 12-152-453 : polymorphic base C or T
  misc_binding 481..500: 12-152-453.mis1, potential
  misc_binding 502..521: 12-152-453.mis2, potential complement
  primer_bind 50..68: upstream amplification primer
  primer_bind 553..572: downstream amplification primer, complement
  misc_binding 489..513: 12-152-453 potential probe
  misc_feature 260: n=a, g, c or t
gccacggctctgggcaggaggcttagggaattgggggctcccaagtgtttaaaggggatgagtgggagccggggggatgtcagatattttgacactgtgtcaggaacccgacatctgtgccctgcgagggaggggcgtggagcctggcacccgtgggactcatgggaatgaacactgcccttccgggtggaagggaccaggtgctggtccctcggaggctgcagtgaggctgtggcctttgcattagtttgttagggttngctgtaacaaagaaccacacatgcgtagcttgaagcaacagagatgtattctctgtacgtcctggaggtcaggagtccaaactcagggtgtcggcagggctgtgctccttctgaaggctctaaggaagcaagctctcttgcctcttccagcttctggtggccccacatgttctgtgactgtggcagcatcactccaatttctcccttcctcattgcgtggcctttccctgtgtgtccctcygtgtcctcttcttacaaggacacctacccaaaatccaggatgatctcacttcgaaatcctgaactaattccatcacaaagaccctatttccaaataaggtcacattatcagattctgggcgagcctgaattttggaaggacaccggtcaactcaaggcagccttggtagaggggtgagatgtgtgagatggagccgttgcagtgttccgcgtggagctgtggatggggctggtgcccatgtaaagggatcactcatctataaggagggtgtgggtctcagctcttaaagcaaggagtggaaagggatgtgactgatttaggagccatctgtagatcattctggctaaataatgggattcacttttaagtgaaggaggccttgaatgccacactcaggggcctagcgcagcacttcccaagccttgctgtggttaggaacaacctgggggctgggtgaaatgcaggcttggattcagcaggaccggggtagggcctgagag

SEQ ID NO: 342 - DNA, 1001 bp, Homo Sapiens
  allele 501: 12-153-116 : polymorphic base C or T
  misc_binding 482..500: 12-153-116.mis1
  misc_binding 502..520: 12-153-116.mis2, complement
  primer_bind 386..405: upstream amplification primer
  primer_bind 867..887: downstream amplification primer, complement
  misc_binding 489..513: 12-153-116 potential probe
ttcttgtgggcttataaaaagccctagtgcctgagaaaaagagggccacatgtgttcactgttcactgccctctgacctggaatccccaggatgtgggcagggtcatactccaggcctcgcccttgaccccgtctctgtccttgaaggagagggacccagacacccccgagtgctcagttctcacacacacaggcacgcagagtaaaaatgaaggtgctgtggggggttggaagggcagggtgcagcctgctcgctacggcaaggcatgagcacttccactcgggaagctgggctgggaaggcttggttctgcttccagcccctctggcgccaagtgcattcccctgttgctgttggtagccatggagaccttctgtgagacggtgcagttttatctgaagcacctggaggagagcgtgtaccccgtgatgactgaggaggagtttgccctgaaggtgttccccatgtatcgctacttcgtgacagtgtggctgaggcacyacaaccccgaggtgagatgcacccctcttaggagggcctggtggtccccaggccacagctccccagcctgtggggccgggaggtgctgagggaccgtcgggtccacacttactcccaggaccctagagggcagtgacctgactcatggcagagccggggaactcatggatgctgaacagctgggacctaggagcctcatccacgaggccaggcttgatgaaggttggtgataatcctgagagcacttgttacatgctgggcactctaccagcgtcttacccatgggagctattttcacacccactctgtgatataggactagttgacaaatgaggaaactcaggcacagaggggttaagtacctgctcaaggtcatgtggctgctaagtgggagggactcaaacccggccgcctgtgcaggaaagaccttgctctgcttctgaggcgccttctgtcctgtgtccttggattctgtggctggggctgaggtcactggcctt

SEQ ID NO: 343 - DNA, 1000 bp, Homo Sapiens
  allele 501: 12-154-480 : polymorphic base C or T
  misc_binding 481..500: 12-154-480.mis1, potential
  misc_binding 502..521: 12-154-480.mis2, potential complement
  primer_bind 23..43: upstream amplification primer
  primer_bind 522..540: downstream amplification primer, complement
  misc_binding 489..513: 12-154-480 potential probe
ccatggagatgcagtgcagcatcttcaagtctctaattcttacatctgtctctttcacttgcaagagcccttgtgattacattgtcctgcccggacatccagcataatctccccatgtcaaaacccttaatataatcacatctataaagtctcttccacctgtaatggaatatattcccaggtttgcgcaactacaatgtagatactttgtggggctgtgattctgcctaccacagacactaagcttaaagtgaaacccacatcttattcaaaacttggaggttttccttcatttggccatttaaatttaatttttgtttctgtcctccgtagtcttctattctccaggcttcagagctctcagcttaccattcaattatctcctttctctccttatattccttttttcattttttaaaaacaatactttcaaagagcaaaaattttagaatttgatgaggtttattctagtgaagtttttatcgtttgtactttttgtaycctaaggaagctttgtttaccccaagatatagtttctacattctcttaaaaacactaaagagttccagtttatatgtttagctctgtgagattgggagaggggagctagatcactcaggtcaggctttcgggatgcctttttctgtctctggacgttgctggggtgacctcactgacacccatggcttcagctaccacatatgctgatggctccaagtctatctgtgcagcccagacccctcctcatctccagaccctggaagctgatgccttgggcagctcctcctatttcccaggcaccaggaatgtgagcttctccctccccacagtcctgctgtcctcagggcccctatgtctctgaaggcaccaccatcttccaagatacatgggcctccgcagggtctaggagtgccagacacgtaaccagaaatcagatgacatcactatctaaataaaacaccactacatggaaatagaacaccactacatggaaatagaa

SEQ ID NO: 344 - DNA, 1001 bp, Homo Sapiens
  allele 501: 12-155-403 : polymorphic base A or C
  misc_binding 481..500: 12-155-403.mis1, potential
  misc_binding 502..521: 12-155-403.mis2, potential complement
  primer_bind 99..116: upstream amplification primer
  primer_bind 628..647: downstream amplification primer, complement
  misc_binding 489..513: 12-155-403 potential probe
  misc_feature 49,58,62,639: n=a, g, c or t
tgggactttggaagaattatcacccttaaggtttaaattaaactgtgantttcagaantttnctaataaggacacaacaaagagtgaaagcattgctatgtctattctgcttgcccagaatcttggtcctaaaaaatgaagagtgtttgggtgtggggaggagcttcagtgtgcatgtgcatgcaaagtacctactctaaggagaagaatgagagggtaccctaattacctgttaatatgtcccataggacaccaaaactctagttagctgtttctctatgatcctctaagcacatccccaagtatggctggccagtgatgtgtatggttcaaatgttgggatctgtgcagttatcttggaattgtatagtacagcagtatatcccccccaaaaagagtgtaatacttccaattctggctgcacaatacttgccccatagtccatggtcaataaatacaaatttgagttgtttttgctcatctttcccttttgacttcaamtcagtcatcagaatttccccaaatgcctttcccctggatcttgggccagtggaatgagtacaatttaacttaattgaatttgcttatctatttggtttcctgttgtgaacaaaagttctctgaaaaggaatttggaanaaagagactttgttctagtgaacagtttgcaaaccagggagttacagcctctggtacgcaatgaaggtgagttccacagaacacaaggcaggcaggtttcacggcaaaaagttccttcccaggttcccaatcaggtccatttatgcaaatgaaggatggaaacttgcttagttcttattggtcactgcagctgcattctgattggttgatgaagctgagccctgagtggctgaggtgggtgagctttaattggttggttcaggtgagcgctgaaaatctcaactataaaaaggtacaggttttcaggatactcagagtaaccgtgtgacctgtagtaagcaaagggccagttggctctattt

SEQ ID NO: 345 - DNA, 1001 bp, Homo Sapiens
  allele 501: 12-156-91 : polymorphic base A or G
  misc_binding 482..500: 12-156-91.mis1
  misc_binding 502..520: 12-156-91.mis2, complement
  primer_bind 412..429: upstream amplification primer
  primer_bind 844..862: downstream amplification primer, complement
  misc_binding 489..513: 12-156-91 potential probe
cagctgtccgtgtcttctgctgagatggccacaggactccaggttcccctgccgtggctggccacaggactgctgcttctcctcagtgtccagccctgggctgagagtggaaaggtgttggtggtgcccattgatggcagccactggctcagcatgcgggaggtcttgcgggagctccatgccagaggccaccaggcagtggtcctcaccccagaggtgaatatgcacatcaaagaagagaactttttcaccctgacaacctatgccatttcgtggacccaggatgaatttgatcgccatgtgctgggccacactcaactgtactttgaaacagaacattttctgaagaaatttttcagaagtatggcaatgttgaacaatatgtctttggtctatcataggtcttgtgtggagctactacataatgaggccctgatcaggcacctgaatgctacttcctttgatgtggttttaacagaccccgttaacctctgcgcggcrgtgctggctaagtacctgtcgattcctactgtgttttttttgaggaacattccatgtgatttagactttaagggcacacagtgtccaaacccttcctcctatattcctagattactaacaaccaattcagaccacatgacattcatgcaaagggtcaagaacatgctctaccctctggccctgtcctacatttgccatgctttttctgctccttatgcaagccttgcctctgagctttttcagagagaggtgtcagtggtggatattctcagtcatgcatctgtgtggctgttccgaggggactttgtgatggactaccccaggccaatcatgcccaacatggtcttcattgggggcatcaactgtgccaacaggaagccactatctcaggtctgtattggtgccttcatccaatcaatgttccaggcaaaacactttttaaaaaaatgtatttatttaaaattgcttccatatttacttatctttccaaatatttcatt

SEQ ID NO: 346 - DNA, 1001 bp, Homo Sapiens
  allele 501: 12-157-437 : polymorphic base A or C
  misc_binding 481..500: 12-157-437.mis1, potential
  misc_binding 502..521: 12-157-437.mis2, potential complement
  primer_bind 67..87: upstream amplification primer
  primer_bind 513..533: downstream amplification primer, complement
  misc_binding 489..513: 12-157-437 potential probe
tcttttctataattctcagccagatttcaagttgggtgcttctccttggatttatggcacatgggtgggctgctcttccattgattggggatattttgagcaaaataacagtgataacactgaagagcattgcaagcatccttcaagatgagtcaggctcagtgagtgagttgaagggctcagtcaactatttgttgataccactggtacaaaatgatctaaagcccaagacttaccttcctggagatgccaatccattggtggggagggggaaaggggaagaagttatggatttataaaattagtatttaaagagtttgggtcatctctaagaatacctcccctataggggaagattcattacttaggcgcatagcagaactatctgttactttaagctgcatcaaacaggcagattttaaaataaatgtcatgaacatcaactaagcacaatgatatgctgagtactgaagggacacagagatacataagacctagtcmcagccttttaaggacttagagataagacagacacatacaaacaggattataggtcaaagctgactaacaggactgtgtttacaggtaaacccacacacacatcagcaaaaaaatatctgagaacaaaaaaaaaggggctactaacaaaagcaactcagtttatacaaaaggagctatcaagaggcttggtgcaaagttggcatttggcttttgacctgggcttaggcagaacgactggacttggcgcttcctaggagagtgtaatacaagacactttgggggagcaggagtttaaagcaggatggtggctctcaactctaggggcacaatagaactcatggggaacttttaacagtatggatatccaggtcccaccccagatcctggggcttggacgtggtccctgggggtccttaaaaaatcctcgaggtatctttaatatgcatcaagcttgagaattgttgatgaaggagctagaagaagaatgagctagcatgcac

SEQ ID NO: 347 - DNA, 1001 bp, Homo Sapiens
  allele 501: 12-158-213 : polymorphic base T or C
  misc_binding 481..500: 12-158-213.mis1, potential
  misc_binding 502..521: 12-158-213.mis2, potential complement
  primer_bind 691..710: upstream amplification primer, complement
  primer_bind 230..247: downstream amplification primer
  misc_binding 489..513: 12-158-213 potential probe
ttttctgtctctggacgttgctggggtgacctcactgacacccatggcttcagctaccacatatgctgatggctccaagtctatctgtgcagcccagacccctcctcatctccagaccctggaagctgatgccttgggcagctcctcctatttcccaggcaccaggaatgtgagcttctccctccccacagtcctgctgtcctcagggcccctatgtctctgaaggcaccaccatcttccaagatacatgggcctccgcagggtctaggagtgccagacacgtaaccagaaatcagatgacatcactatctaaataaaacaccactacatggaaatagaacaccactacatggaaatagaacatgggagccccttgaatgtggcaagagcaccctcccaggcatgttccaccctcaccccgggctcatcaggagggttcttaagatgcagacagttttaagggggttggaggaatagttgagaagctgagatgttgcaccyacagctgagaatccctttctagcactctgtgtcctcacaaatccccagaaatcgtcctcccctggggagttctcaagcccttacagacctgccctctctgtgccatcctgcatatgcctcccttgagctgggtgtccctctgatggacgcatccattcactgcctgtcccatgggttgtgtccaaaggtggaatctgttatcaatgtggatttctaatgggagtaacttcctccataagggaagcctcagcctcaccagcaatggcagacatggccaggcatgtagacacagaggtagtgagatggaaagtgggcacagcccagagagcctgcccacctcatcctggggcgaccaggacaaggaagcatcagcaatcttgcgagcacatgtaggagtgactttctggagcaggacgagcctcatgggcatgagaccattgtgagtgctcagggtctccccctagaaaggcacacatttaattctccattttgaaatttga

SEQ ID NO: 348 - DNA, 980 bp, Homo Sapiens
  allele 480: 12-158-450 : polymorphic base T or G
  misc_binding 460..479: 12-158-450.mis1, potential
  misc_binding 481..500: 12-158-450.mis2, potential complement
  primer_bind 907..926: upstream amplification primer, complement
  primer_bind 446..463: downstream amplification primer
  misc_binding 468..492: 12-158-450 potential probe
atactttcaaagagcaaaaattttagaatttgatgaggtttattctagtgaagtttttatcgtttgtactttttgtaccctaaggaagctttgtttaccccaagatatagtttctacattctcttaaaaacactaaagagttccagtttatatgtttagctctgtgagattgggagaggggagctagatcactcaggtcaggctttcgggatgcctttttctgtctctggacgttgctggggtgacctcactgacacccatggcttcagctaccacatatgctgatggctccaagtctatctgtgcagcccagacccctcctcatctccagaccctggaagctgatgccttgggcagctcctcctatttcccaggcaccaggaatgtgagcttctccctccccacagtcctgctgtcctcagggcccctatgtctctgaaggcaccaccatcttccaagatacatgggcctccgcagggkctaggagtgccagacacgtaaccagaaatcagatgacatcactatctaaataaaacaccactacatggaaatagaacaccactacatggaaatagaacatgggagccccttgaatgtggcaagagcaccctcccaggcatgttccaccctcaccccgggctcatcaggagggttcttaagatgcagacagttttaagggggttggaggaatagttgagaagctgagatgttgcacccacagctgagaatccctttctagcactctgtgtcctcacaaatccccagaaatcgtcctcccctggggagttctcaagcccttacagacctgccctctctgtgccatcctgcatatgcctcccttgagctgggtgtccctctgatggacgcatccattcactgcctgtcccatgggttgtgtccaaaggtggaatctgttatcaatgtggatttctaatgggagtaacttcctccataagggaagcctcagcctcaccagcaat

SEQ ID NO: 349 - DNA, 1001 bp, Homo Sapiens
  allele 501: 12-161-157 : polymorphic base A or G
  misc_binding 481..500: 12-161-157.mis1, potential
  misc_binding 502..521: 12-161-157.mis2, potential complement
  primer_bind 345..363: upstream amplification primer
  primer_bind 729..749: downstream amplification primer, complement
  misc_binding 489..513: 12-161-157 potential probe
cagtcatgtggaactgtgagtcaattaaacctctttcttttataaattacccagtctcagctgcgtctttatagcaggctgagaatagactaatacaagattggtggtgattgaagttatactgaaagggtttaaaggagagtctgagaaaaggaaatgaatctgcatttattgagaaagttgatgagaaagtggaattagaaattcctagaaaggtaagttgttgtgtgaattatttcccaaaatggggaagtctctctacctgtttggagacagaaagtggaatcagaggagaagaagatgatggacagaaaggatcattccctcttccagatgctttccagtgtgtgatgtaagctgaactaaaatcagctgtgttgaactccagccagaaaaaatgtccggcattttgttttttgggaccctaatgaaatggttacaggtctccaggtctcttggggctcacagggtcatgcctttccttgcccagtgtacttggtragaaggtacaggtgtttccatggagggtgttcattttagggatttcaagagggtcatctttgcaccacaggaaatgcccccttttacactctgaaaaccttatcaaaccgttgtataaaagatgaatacccacataacaggctctagcactgttctgtttttgagctgagacattttaaaaggagatttttcaattctaaaaattctttaaataaaatgctcttgcagggacaacatagtaggtcaacattgttcccatctccacaaaaagttttttttttaattagctaggtgtggtagcatttctgtagtcctagctactgggaatgctgaggaggaaggatcacttgagcccaggaattcgtggttacagtaagctatgatcttgcctaggtaacagctacagagcgagaccctgtctttaaaacaaacaagcaaacagacaatcaagctttacacttctataaaagcaacactttccatttatgacagcactaatc

SEQ ID NO: 350 - DNA, 998 bp, Homo Sapiens
  allele 498: 12-162-21 : polymorphic base A or G
  misc_binding 478..497: 12-162-21.mis1, potential
  misc_binding 499..518: 12-162-21.mis2, potential complement
  primer_bind 478..497: upstream amplification primer
  primer_bind 909..927: downstream amplification primer, complement
  misc_binding 486..510: 12-162-21 potential probe
agctgatgccttgggctgctcctcctatttcctgggcaccaggaatatgagctactccctccccacagtcctgctctccccagtgctcccatgtcgctgaaggcaccaccatcttccaagatacatgggcctccccagggtctaggagtcctagacgtgggagtagaaattagatgacattggtgtctaaacaaaacaccactgcatggagatagaacaggggagccccctgaatgtggtgagagcaccctcccaggtgtgttccaccctcaccccgggctcatcaggagggtgcttaggatgcatacagttttaagggggttggaggaatagttcagaggctgagatgttgcacccacagctgagaatccctttctagcgctctgtgtcctcacaactccccgggaatcatcctcccctggagagttcccaaagcccttgcaggcctgccttctctgtgccttcctgcctgcgccctctggtggacagctccattcrctgcctgtcccatgggttctgtccaaaggtggaatctattatcaatgtggatttctaatgggggtaacttcctccctaagggaagcctcagcttcaccagcaatggcagacacggccaggcatgtagacacagaggaagtgagatagaaagtgtgcacagcccagagagcctgcccacatcatcctggggcgaccaggacaaggaggcgtcagcaatcttgccaagcacaagtatgagtgactttctggagcaggacgagtctcatgggcgtgagaccattgtgagtgctcagggtctctccattagaaaggcacacgtttaattctccattttgaaatttgaactagagcccccacaaattattctgttctggaggaaccattcttatcagaacttggtgctggattgacttggaaaaaagcctgaccataatcttcaggatgaaataaaggcctggatgaatggacacttcagtctctaagcagacttgcagaagact

SEQ ID NO: 351 - DNA, 1001 bp, Homo Sapiens
  allele 503: 10-470-25 : polymorphic base A or T
  misc_binding 484..502: 10-470-25.mis1
  misc_binding 504..523: 10-470-25.mis2, potential complement
  primer_bind 479..498: upstream amplification primer
  primer_bind 880..899: downstream amplification primer, complement
  misc_binding 491..515: 10-470-25 potential probe
  misc_feature 271,364,831,842: n=a, g, c or t
ccttttacagctacttttttttctcttttgaaaaaagactggaaaactctgacaaactttaagtgaagtgtaaaggattatagaataagataaatgtaggtttacgtaatcccagctgtgagtaacttttcctcagtgctcagagtcagggaagtcaaccactaatgacttcaaactaaaataattctgtagaaaacctgcctaaaataagcatatgtgatttagcgagcaacaatatagcattaaagccaactggtgccactttaaagancctatattagtacttataatatgataagtgaagagtttgggtatctcctcaaatactgtgtaataactctatttcatttctccctttcacaancgcacacacatacacacacacatatttacacaaagacccttaacagaggcaacctatctcatattatacatattgcaaaaaaaaactgagtaattgagtcagttaaaaaacatcctttactccaataattcctgataawacttgattttctctctttttataacaattctttcacagtgcttgctgtgctgataatctattatgatagaacaaattcttttttttcacaggaaatggaagagtttgtccagagctctggagaaaatggtgttgtggtgttttctctggggtcgatggtcagtaacacgtcagaagaaagggccaatgtaattgcatcagcccttgccaagatcccacaaaaaggtaagataaaatgttttaatggtgtaaaaaactactgaaagaggctgttaaagtttgtaaagaacccaaattgtagaaacttcctgcctatatatttcagctgntgggaaaagcnctaattatctcagatattaattcaaaatcaaaaatatgtatggaagatgataaactcatacagaaggtgtttttcattggtaattaatttggcattaatattgtgatcaggaataaatacaattaagagttgcaggtaaagttttggtattatcatgat

SEQ ID NO: 352 - DNA, 1001 bp, Homo Sapiens
  allele 503: 10-471-84 : polymorphic base A or T
  misc_binding 484..502: 10-471-84.mis1
  misc_binding 504..523: 10-471-84.mis2, potential complement
  primer_bind 420..439: upstream amplification primer
  primer_bind 788..807: downstream amplification primer, complement
  misc_binding 491..515: 10-471-84 potential probe
atttactttgaatgatctggcactttaaaaacctttcgtggacttgatgtgctcaggcaaattaacttaccttctctttttttgagagggaagtctcactctgtcaccaggctggagtgcagtggtgtgattgtggctcactgcaacttccgcctcttgggttcaagcgattctcctgcctcagcctctcaagtagctgggactacaggcacatgccaccacgcctgggtaatcttttttttttttttttttttttttcatatttttactggagacggggtgacggggtttcaccgtgttagccaggatggtcttgatctcctgacctcgtgatccgcccgcctcgacctcggaaagtgctgggattgcaggtgtgagcctccgtgcttggccaaattaacttactttcaatgttgatacttttctgcttatcgtttagatataaagagaatgctatgaaattatcaagaattcatcatgatcaaccagtgaagccccttgawagagcagtcttctggattgaatttgtcatgcgccataaaggagccaagcaccttcgggttgcagcccacgacctcacctggttccagtaccactctttggatgtgactgggttcctgctggcctgtgtggcaactgtgatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggtta

SEQ ID NO: 353 - DNA, 1001 bp, Homo Sapiens
  allele 503: 10-471-85 : polymorphic base A or C
  misc_binding 483..502: 10-471-85.mis1, potential
  misc_binding 505..523: 10-471-85.mis2, complement
  primer_bind 420..439: upstream amplification primer
  primer_bind 788..807: downstream amplification primer, complement
  misc_binding 491..515: 10-471-85 potential probe
atttactttgaatgatctggcactttaaaaacctttcgtggacttgatgtgctcaggcaaattaacttaccttctctttttttgagagggaagtctcactctgtcaccaggctggagtgcagtggtgtgattgtggctcactgcaacttccgcctcttgggttcaagcgattctcctgcctcagcctctcaagtagctgggactacaggcacatgccaccacgcctgggtaatcttttttttttttttttttttttttcatatttttactggagacggggtgacggggtttcaccgtgttagccaggatggtcttgatctcctgacctcgtgatccgcccgcctcgacctcggaaagtgctgggattgcaggtgtgagcctccgtgcttggccaaattaacttactttcaatgttgatacttttctgcttatcgtttagatataaagagaatgctatgaaattatcaagaattcatcatgatcaaccagtgaagccccttgamagagcagtcttctggattgaatttgtcatgcgccataaaggagccaagcaccttcgggttgcagcccacgacctcacctggttccagtaccactctttggatgtgactgggttcctgctggcctgtgtggcaactgtgatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggtta

SEQ ID NO: 354 - DNA, 1001 bp, Homo Sapiens
  allele 503: 10-472-202 : polymorphic base C or T
  misc_binding 484..502: 10-472-202.mis1
  misc_binding 525..543: 10-472-202.mis2, complement
  primer_bind 304..322: upstream amplification primer
  primer_bind 714..732: downstream amplification primer, complement
  misc_binding 491..515: 10-472-202 potential probe
gatataaagagaatgctatgaaattatcaagaattcatcatgatcaaccagtgaagccccttgaaagagcagtcttctggattgaatttgtcatgcgccataaaggagccaagcaccttcgggttgcagcccacgacctcacctggttccagtaccactctttggatgtgactgggttcctgctggcctgtgtggcaactgtgatattcatcatcacaaaatgtctgttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccataygaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaagctaataaataattaaattgtatagaaagtctcttcctcttgatattttgagatgattagtgctgcttggcttttattgtgcatcgtgcttcaacgtcattttttttcctaaaaggtatgataaaaatgcttaccattttagagcttaagtcatttcccagtgaaaagtatgtggaattagaaatatagcaactcctacctggtttctactacaaaatgaactaattttacaatgcgtttggttttttgagccaattctatttttctgttcatttg

SEQ ID NO: 355 - DNA, 1001 bp, Homo Sapiens
  allele 503: 10-473-333 : polymorphic base C or T
  misc_binding 483..502: 10-473-333.mis1, potential
  misc_binding 504..523: 10-473-333.mis2, potential complement
  primer_bind 171..189: upstream amplification primer
  primer_bind 582..600: downstream amplification primer, complement
  misc_binding 491..515: 10-473-333 potential probe
  misc_feature 887: n=a, g, c or t
gaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaagctaataaataattaaattgtatagaaagtctcttcctcttgatattttgagatgattagtgctgcttggyttttattgtgcatcgtgcttcaacgtcattttttttcctaaaaggtatgataaaaatgcttaccattttagagcttaagtcatttcccagtgaaaagtatgtggaattagaaatatagcaactcctacctggtttctactacaaaatgaactaattttacaatgcgtttggttttttgagccaattctatttttctgttcatttgaaaatattcatctttttttattctttgttttttaggtatttcaatagcttttgggtgacaactggtttttggttacatggataagctctttagtggtgatttttcagattttggtgcactcattactcaagaagtatacactgtacccagtgtgtactgttttatccctcacatccctncctacccttccctctgagttccaagagtccattatatcattcttatgcctctatgtcctaatagcttaggtcccccttataagtgagaacatacattgtttggttttatatttc

SEQ ID NO: 356 - DNA, 1001 bp, Homo Sapiens
  allele 503: 10-494-284 : polymorphic base C or T
  misc_binding 483..502: 10-494-284.mis1, potential
  misc_binding 504..523: 10-494-284.mis2, potential complement
  primer_bind 220..238: upstream amplification primer
  primer_bind 624..641: downstream amplification primer, complement
  misc_binding 491..515: 10-494-284 potential probe
ctggtgtgagatggtatctctttgtggatttgaccagtgatgtaaacctttttttcatatagtggtttgccacatatagttttcttttgaaaagtgtaacaactttttaaatacttgaacttttcattgattatcttatttgtctaagctactattttgaaaaatcatgatttccttatatacctaattatgaaattaaggaaatgaaatatgagtattctatttacatcagtctgagtagttcttgttacttaacatcccttgttcttctcattgttaatctctttagatttctaacattctatgacttttgagttccactcatggaataagatattttcttcactgtaacaggttctgtggagatttgatgggaataaaccagatactttaggactcaatactcggctgtacaagtggataccccagaatgatcttcttggtaagtctctgaagaacaaatactgaatatattagtaacagattattaaagtgttaatagytatcatgaaacaagcttactgaacatttgttatggaaaaacttaaaatgaaacttctttatatttattttccagtcccgggggaaaagaataaatgataattgttggcattttatgatatgcacccacattctttacaatcagagtcagagtatctttatttcaggtgttattacctcccacagaatttttctggcacttcctgggttgtcttcctttctcatatttctacaactttacacctgttctttcctcctctgtagggttatttcaaatgtcactaaaagtaacagctcttctgctatcaccagggatgctgcattttctgtaggattaaatccctaatcttaatcaaaaagtgatgacacatttcataatgaaatgtgacctgtctttcctcaattctagcaccaccaccacctcactgcctgctgccttgcacaccctacatatcacactccgtgactgtacttaagagaacacattctggctgggcacg

SEQ ID NO: 357 - DNA, 1001 bp, Homo Sapiens
  allele 499: 12-637-219 : polymorphic base G or A
  misc_binding 500..519: 12-637-219.mis1, potential complement
  misc_binding 480..498: 12-637-219.mis2
  primer_bind 698..717: upstream amplification primer, complement
  primer_bind 230..250: downstream amplification primer
  misc_binding 487..511: 12-637-219 potential probe
  misc_feature 953: n=a, g, c or t
ttttgtgtctggaagtttgttagaacaggaaagaaggggaaaagagattaattacgtctgaggctggaagctgggaaacccaataaatgaactcctttagtttattacaacaagaagacgttgtgatacaagagattcctttcttcttgtgacaaaacatctttcaaaacttaccttgtcaagtcaaaatttgttttagtacctgtttaaccattagaaatatttcatgtcaaggaggaaaacattagggaaaacaaaaatgatataaagccatatgaggttatattgaaatgtattgagcttatattgaaatttattgttccaattcacaggttacatgaaaaaaaatttactaagcttaactacatgtcacacattgtacatggaaacaagaacattaagaagtccactgacagtatcagtactgttttgcaaatactcagcatactttggatccatttcatgcaggattgtgttgttttaactgttgttgaggaarctaataaataattaaattgtatagaaagtctcttcctcttgatattttgagatgattagtgctgcttggcttttattgtgcatcgtgcttcaacgtcattttttttcctaaaaggtatgataaaaatgcttaccattttagagcttaagtcatttcccagtgaaaagtatgtggaattagaaatatagcaactcctacctggtttctactacaaaatgaactaattttacaatgcgtttggttttttgagccaattctatttttctgttcatttgaaaatattcatctttttttattctttgttttttaggtatttcaatagcttttgggtgacaactggtttttggttacatggataagctctttagtggtgatttttcagattttggtgcactcattactcaagaagtatacactgtacccagtgtgtactgttttatccctcacatccctncctacccttccctctgagttccaagagtccattatatcattcttatgc

SEQ ID NO: 358 - DNA, 668 bp, Homo Sapiens
  allele 499: 12-639-95 : polymorphic base G or A
  misc_binding 500..519: 12-639-95.mis1, potential complement
  misc_binding 480..498: 12-639-95.mis2
  primer_bind 573..593: upstream amplification primer, complement
  primer_bind 144..164: downstream amplification primer
  misc_binding 487..511: 12-639-95 potential probe
  misc_feature 57,198,240,552,616,630: n=a, g, c or t
aataaacaagggacctttgtgtatttgtgaattactttttaatttcctatctgatanaagctttcttgtaatgacctctaactttttgctgaaacctgagttactttaacactgatgtagcaaataaaagttaaacactgtaaattattgttcagtttgtgaggattgcttcggagtttcaaaattagtaacttaaanataaaaatgtcttggctatagcagaacatattattcactgtntgtcaaatctttgtagcacgttgtctaagtgttaataatcagttgaccaaattccgcaaaatacaattttgagtttattcaatagctttttttgtattcatgataccaacaggttcctcatttctaggccaaaaaaaaatccaaaattaacaatactggtaatattctgaatttgtgtcaaaaattgtcacttgaaatttttcttggaagtagtgcttgataatttgtaattctaatgaagttatacataaaaccctarcagcatttatttatttcttataagtagcttattttatagacttgctattttgncaatcaaaggacaacaggctctaatataataacctaccgacaaagtagatacatttgaacttcntctcttattattcnaaaacaaatgaatacactgcaattaaatttggagatga

SEQ ID NO: 359 - DNA, 814 bp, Homo Sapiens
  allele 499: 12-639-241 : polymorphic base T or G
  misc_binding 479..498: 12-639-241.mis1, potential
  misc_binding 500..519: 12-639-241.mis2, potential complement
  primer_bind 719..739: upstream amplification primer, complement
  primer_bind 290..310: downstream amplification primer
  misc_binding 487..511: 12-639-241 potential probe
  misc_feature 38,95,116,203,344,386,698,762,776: n=a, g, c or t
taactaccagattaacaactcctcccaatggaggcagncagaaggaagtatagaaaggagtcaaacagaaggaagccaagtgggggaacaggttncagatgtcccctccatagaancatagtaggaatatattttcttctatataaaataaacaagggacctttgtgtatttgtgaattactttttaatttcctatctgatanaagctttcttgtaatgacctctaactttttgctgaaacctgagttactttaacactgatgtagcaaataaaagttaaacactgtaaattattgttcagtttgtgaggattgcttcggagtttcaaaattagtaacttaaanataaaaatgtcttggctatagcagaacatattattcactgtntgtcaaatctttgtagcacgttgtctaagtgttaataatcagttgaccaaattccgcaaaatacaattttgagtttattcaatagctttttttgtattcatgataccaacagkttcctcatttctaggccaaaaaaaaatccaaaattaacaatactggtaatattctgaatttgtgtcaaaaattgtcacttgaaatttttcttggaagtagtgcttgataatttgtaattctaatgaagttatacataaaaccctagcagcatttatttatttcttataagtagcttattttatagacttgctattttgncaatcaaaggacaacaggctctaatataataacctaccgacaaagtagatacatttgaacttcntctcttattattcnaaaacaaatgaatacactgcaattaaatttggagatga

SEQ ID NO: 360 - DNA, 1001 bp, Homo Sapiens
  allele 499: 12-640-151 : polymorphic base G or A
  misc_binding 479..498: 12-640-151.mis1, potential
  misc_binding 500..519: 12-640-151.mis2, potential complement
  primer_bind 629..649: upstream amplification primer, complement
  primer_bind 156..176: downstream amplification primer
  misc_binding 487..511: 12-640-151 potential probe
  misc_feature 62: n=a, g, c or t
agaaatagcacatcaatttaacagtgtgatttcagggcaataggtgttccacctaaacaatnaacctgaaaggtacaattattcaacaactaactataaactctacaattccatgtgataaatgagactcccaagactgattcataaaaattccaaatcacaatactagactcaggaatgtcagtgattcttaaccaccagcttttattttcattttttgaaaaactactggaaaactctgacaaactttaagtgaagcataaagcattgtagaggaacataaatgtagatataaaattatcccaactgtgaatagcttttcctcagtgctcatatttagggaagtagaccactaatggcttcaaactaaaagaattctacagaaaacctgcctgaaataaacacaagtgatttagtagaacaaaaatataggattaaagcctagtggtgccacttttccaagaacttatattagtaattatagtattataagtgaagrgtctgggtatattttttcacattatctccctgactacaatgtaatagctccatttcttttctccattacacacatgcagacacatacatacatatacacacatatttacacaaatatccttaacagaggccaactatctcaaatatcttcttgcaaagaaactgagtgattgagtcagttaaaaaatattatttactccaataattcctcaaaatacttgattttctctctttaatatttggtaccagttctttagtagtgcctgctgtggtgatactcttttgtgattaaacaatttttttttcacaggaaatggaggagtttgtacagagctctggagaaaatggtgttgtggtgttttctctgcggtcaatcataagtaacatgacagcagaaagggccaatgtaattgcaacagccctggccaagatcccacaaaaggtaagataaagtaccttactggtgtggaaaactactgaaagaggcttgagatccatataga

SEQ ID NO: 361 - DNA, 1001 bp, Homo Sapiens
  allele 499: 12-640-296 : polymorphic base T or G
  misc_binding 479..498: 12-640-296.mis1, potential
  misc_binding 500..519: 12-640-296.mis2, potential complement
  primer_bind 769..789: upstream amplification primer, complement
  primer_bind 296..316: downstream amplification primer
  misc_binding 487..511: 12-640-296 potential probe
  misc_feature 1..4,6..8,12..22,25..28,30,32..37,39,41..44,47..50,202: n=a, g, c or t
nnnntnnngtgnnnnnnnnnnnctnnnnanannnnnnanannnnccnnnngaagaaaggcctggtggcctcttctattctggtgccagtgctgcctctgagacacaacaaagtgatgatgagagttcctcacatgcagttagaaatagcacatcaatttaacagtgtgatttcagggcaataggtgttccacctaaacaatnaacctgaaaggtacaattattcaacaactaactataaactctacaattccatgtgataaatgagactcccaagactgattcataaaaattccaaatcacaatactagactcaggaatgtcagtgattcttaaccaccagcttttattttcattttttgaaaaactactggaaaactctgacaaactttaagtgaagcataaagcattgtagaggaacataaatgtagatataaaattatcccaactgtgaatagcttttcctcagtgctcatatttagggaagtagaccactaatgkcttcaaactaaaagaattctacagaaaacctgcctgaaataaacacaagtgatttagtagaacaaaaatataggattaaagcctagtggtgccacttttccaagaacttatattagtaattatagtattataagtgaagagtctgggtatattttttcacattatctccctgactacaatgtaatagctccatttcttttctccattacacacatgcagacacatacatacatatacacacatatttacacaaatatccttaacagaggccaactatctcaaatatcttcttgcaaagaaactgagtgattgagtcagttaaaaaatattatttactccaataattcctcaaaatacttgattttctctctttaatatttggtaccagttctttagtagtgcctgctgtggtgatactcttttgtgattaaacaatttttttttcacaggaaatggaggagtttgtacagagctctggagaaaatggtgttgtggtgttttc

SEQ ID NO: 362 - DNA, 1001 bp, Homo Sapiens
  allele 499: 12-640-325 : polymorphic base T or C
  misc_binding 500..518: 12-640-325.mis1, complement
  misc_binding 479..498: 12-640-325.mis2, potential
  primer_bind 797..817: upstream amplification primer, complement
  primer_bind 324..344: downstream amplification primer
  misc_binding 487..511: 12-640-325 potential probe
  misc_feature 6,24..25,28..32,34..36,40..50,53..56,58,60..65,67,69..72,75..78: n=a, g, c or t
tgcagncaagcacatcttcaccannagnnnnntnnngtgnnnnnnnnnnnctnnnnanannnnnnanannnnccnnnngaagaaaggcctggtggcctcttctattctggtgccagtgctgcctctgagacacaacaaagtgatgatgagagttcctcacatgcagttagaaatagcacatcaatttaacagtgtgatttcagggcaataggtgttccacctaaacaatnaacctgaaaggtacaattattcaacaactaactataaactctacaattccatgtgataaatgagactcccaagactgattcataaaaattccaaatcacaatactagactcaggaatgtcagtgattcttaaccaccagcttttattttcattttttgaaaaactactggaaaactctgacaaactttaagtgaagcataaagcattgtagaggaacataaatgtagatataaaattatcccaactgtgaatagcttttcctcagtgcycatatttagggaagtagaccactaatggcttcaaactaaaagaattctacagaaaacctgcctgaaataaacacaagtgatttagtagaacaaaaatataggattaaagcctagtggtgccacttttccaagaacttatattagtaattatagtattataagtgaagagtctgggtatattttttcacattatctccctgactacaatgtaatagctccatttcttttctccattacacacatgcagacacatacatacatatacacacatatttacacaaatatccttaacagaggccaactatctcaaatatcttcttgcaaagaaactgagtgattgagtcagttaaaaaatattatttactccaataattcctcaaaatacttgattttctctctttaatatttggtaccagttctttagtagtgcctgctgtggtgatactcttttgtgattaaacaatttttttttcacaggaaatggaggagtttgtacagagct

SEQ ID NO: 363 - DNA, 1001 bp, Homo Sapiens
  allele 499: 12-640-413 : polymorphic base C or G
  misc_binding 479..498: 12-640-413.mis1, potential
  misc_binding 500..519: 12-640-413.mis2, potential complement
  primer_bind 885..905: upstream amplification primer, complement
  primer_bind 412..432: downstream amplification primer
  misc_binding 487..511: 12-640-413 potential probe
  misc_feature 94,112..113,116..120,122..124,128..138,141..144,146,148..153,155: n=a, g, c or t
ttttaccccaatgattaaatctgaaaatatttaaatttaaatattggtatacattggggaactcaagtcagaataattctcaatcaattgcagncaagcacatcttcaccannagnnnnntnnngtgnnnnnnnnnnnctnnnnanannnnnnanannnnccnnnngaagaaaggcctggtggcctcttctattctggtgccagtgctgcctctgagacacaacaaagtgatgatgagagttcctcacatgcagttagaaatagcacatcaatttaacagtgtgatttcagggcaataggtgttccacctaaacaatnaacctgaaaggtacaattattcaacaactaactataaactctacaattccatgtgataaatgagactcccaagactgattcataaaaattccaaatcacaatactagactcaggaatgtcagtgattcttaaccaccagcttttattttcattttttgaaaaactactggaaaactctgasaaactttaagtgaagcataaagcattgtagaggaacataaatgtagatataaaattatcccaactgtgaatagcttttcctcagtgctcatatttagggaagtagaccactaatggcttcaaactaaaagaattctacagaaaacctgcctgaaataaacacaagtgatttagtagaacaaaaatataggattaaagcctagtggtgccacttttccaagaacttatattagtaattatagtattataagtgaagagtctgggtatattttttcacattatctccctgactacaatgtaatagctccatttcttttctccattacacacatgcagacacatacatacatatacacacatatttacacaaatatccttaacagaggccaactatctcaaatatcttcttgcaaagaaactgagtgattgagtcagttaaaaaatattatttactccaataattcctcaaaatacttgattttctctctttaatatttggtacc

SEQ ID NO: 364 - DNA, 1001 bp, Homo Sapiens
  allele 499: 12-641-120 : polymorphic base G or A
  misc_binding 479..498: 12-641-120.mis1, potential
  misc_binding 500..519: 12-641-120.mis2, potential complement
  primer_bind 600..618: upstream amplification primer, complement
  primer_bind 127..147: downstream amplification primer
  misc_binding 487..511: 12-641-120 potential probe
  misc_feature 5,519,564,828,846..847,850..854,856..858,862..872,875..878,880: n=a, g, c or t
tgganaatattcacaaaattaacattagaagtaatccaacatctttatacgaaagaatgattaaaacttatgtgcatatagtagcattaaaataattttatcaatgaaatgttcagttacactttcagccataatacaaacaaagtgaattagaaaatgataaatatagcaagatggcaagtttttgcaggaggaaatgtatatacaataagattaaaattttctaaataagtgtcacatgtatacattgacctatataaatttgacaaaatccataataaaaaatacatattttctaaaaattatacctctagatagaaattttagaaaaattatcttttaaaaaggttttcatacttttataaaatttcttacattaattttgtattatttttataatattatcacaaaaggagaaacaagcagtccatatcagtgatgaatctctaaacagaggttagattccttcaacacctggtagaaaaacaaggctctggtrtcaagccagtgagatgaaancactgaaaacgagttacattaaatgtggctacaggtaactgcaantcacatacaacacctagaagccccaggtattacgtggaatagtagtacaaggactctcacgttaacgtaagattaaaaatcatattttaagaaaacactctgccatatgtgatgcactgtttacatttagacttttttttctttgttttgttaaaaaccatttggaaaagttttaccccaatgattaaatctgaaaatatttaaatttaaatattggtatacattggggaactcaagtcagaataattctcaatcaattgcagncaagcacatcttcaccannagnnnnntnnngtgnnnnnnnnnnnctnnnnanannnnnnanannnnccnnnngaagaaaggcctggtggcctcttctattctggtgccagtgctgcctctgagacacaacaaagtgatgatgagagttcctcacatgcagttagaaatagcac

SEQ ID NO: 365 - DNA, 1001 bp, Homo Sapiens
  allele 499: 12-641-122 : polymorphic base T or G
  misc_binding 479..498: 12-641-122.mis1, potential
  misc_binding 500..519: 12-641-122.mis2, potential complement
  primer_bind 602..620: upstream amplification primer, complement
  primer_bind 129..149: downstream amplification primer
  misc_binding 487..511: 12-641-122 potential probe
  misc_feature 7,521,566,830,848..849,852..856,858..860,864..874,877..880,882: n=a, g, c or t
tatgganaatattcacaaaattaacattagaagtaatccaacatctttatacgaaagaatgattaaaacttatgtgcatatagtagcattaaaataattttatcaatgaaatgttcagttacactttcagccataatacaaacaaagtgaattagaaaatgataaatatagcaagatggcaagtttttgcaggaggaaatgtatatacaataagattaaaattttctaaataagtgtcacatgtatacattgacctatataaatttgacaaaatccataataaaaaatacatattttctaaaaattatacctctagatagaaattttagaaaaattatcttttaaaaaggttttcatacttttataaaatttcttacattaattttgtattatttttataatattatcacaaaaggagaaacaagcagtccatatcagtgatgaatctctaaacagaggttagattccttcaacacctggtagaaaaacaaggctctgktgtcaagccagtgagatgaaancactgaaaacgagttacattaaatgtggctacaggtaactgcaantcacatacaacacctagaagccccaggtattacgtggaatagtagtacaaggactctcacgttaacgtaagattaaaaatcatattttaagaaaacactctgccatatgtgatgcactgtttacatttagacttttttttctttgttttgttaaaaaccatttggaaaagttttaccccaatgattaaatctgaaaatatttaaatttaaatattggtatacattggggaactcaagtcagaataattctcaatcaattgcagncaagcacatcttcaccannagnnnnntnnngtgnnnnnnnnnnnctnnnnanannnnnnanannnnccnnnngaagaaaggcctggtggcctcttctattctggtgccagtgctgcctctgagacacaacaaagtgatgatgagagttcctcacatgcagttagaaatagc

SEQ ID NO: 366 - DNA, 1001 bp, Homo Sapiens
  allele 432: 12-641-223 : polymorphic base G or A
  misc_binding 412..431: 12-641-223.mis1, potential
  misc_binding 433..452: 12-641-223.mis2, potential complement
  primer_bind 636..654: upstream amplification primer, complement
  primer_bind 163..183: downstream amplification primer
  misc_binding 420..444: 12-641-223 potential probe
  misc_feature 24,41,555,600,864,882..883,886..890,892..894,898..908,911..914: n=a, g, c or t
atcataaaaaaatcaaggtgtatntattaaaccttatgganaatattcacaaaattaacattagaagtaatccaacatctttatacgaaagaatgattaaaacttatgtgcatatagtagcattaaaataattttatcaatgaaatgttcagttacactttcagccataatacaaacaaagtgaattagaaaatgataaatatagcaagatggcaagtttttgcaggaggaaatgtatatacaataagattaaaattttctaaataagtgtcacatgtatacattgacctatataaatttgacaaaatccataataaaaaatacatattttctaaaaattatacctctagatagaaattttagaaaaattatcttttaaaaaggttttcatacttttataaaatttcttacattaattttgtattatttttrtaatattatcacaaaaggagaaacaagcagtccatatcagtgatgaatctctaaacagaggttagattccttcaacacctggtagaaaaacaaggctctggtgtcaagccagtgagatgaaancactgaaaacgagttacattaaatgtggctacaggtaactgcaantcacatacaacacctagaagccccaggtattacgtggaatagtagtacaaggactctcacgttaacgtaagattaaaaatcatattttaagaaaacactctgccatatgtgatgcactgtttacatttagacttttttttctttgttttgttaaaaaccatttggaaaagttttaccccaatgattaaatctgaaaatatttaaatttaaatattggtatacattggggaactcaagtcagaataattctcaatcaattgcagncaagcacatcttcaccannagnnnnntnnngtgnnnnnnnnnnnctnnnnanannnnnnanannnnccnnnngaagaaaggcctggtggcctcttctattctggtgccagtgctgcctctgagacacaacaaagtga

SEQ ID NO: 367 - DNA, 1001 bp, Homo Sapiens
  allele 388: 12-641-267 : polymorphic base T or C
  misc_binding 368..387: 12-641-267.mis1, potential
  misc_binding 389..408: 12-641-267.mis2, potential complement
  primer_bind 636..654: upstream amplification primer, complement
  primer_bind 163..183: downstream amplification primer
  misc_binding 376..400: 12-641-267 potential probe
  misc_feature 24,41,555,600,864,882..883,886..890,892..894,898..908,911..914: n=a, g, c or t
atcataaaaaaatcaaggtgtatntattaaaccttatgganaatattcacaaaattaacattagaagtaatccaacatctttatacgaaagaatgattaaaacttatgtgcatatagtagcattaaaataattttatcaatgaaatgttcagttacactttcagccataatacaaacaaagtgaattagaaaatgataaatatagcaagatggcaagtttttgcaggaggaaatgtatatacaataagattaaaattttctaaataagtgtcacatgtatacattgacctatataaatttgacaaaatccataataaaaaatacatattttctaaaaattatacctctagatagaaattttagaaaaattatcttttaaaaaggtttycatacttttataaaatttcttacattaattttgtattatttttataatattatcacaaaaggagaaacaagcagtccatatcagtgatgaatctctaaacagaggttagattccttcaacacctggtagaaaaacaaggctctggtgtcaagccagtgagatgaaancactgaaaacgagttacattaaatgtggctacaggtaactgcaantcacatacaacacctagaagccccaggtattacgtggaatagtagtacaaggactctcacgttaacgtaagattaaaaatcatattttaagaaaacactctgccatatgtgatgcactgtttacatttagacttttttttctttgttttgttaaaaaccatttggaaaagttttaccccaatgattaaatctgaaaatatttaaatttaaatattggtatacattggggaactcaagtcagaataattctcaatcaattgcagncaagcacatcttcaccannagnnnnntnnngtgnnnnnnnnnnnctnnnnanannnnnnanannnnccnnnngaagaaaggcctggtggcctcttctattctggtgccagtgctgcctctgagacacaacaaagtga

SEQ ID NO: 368 - DNA, 1001 bp, Homo Sapiens
  allele 503: 12-642-387 : polymorphic base A or G
  misc_binding 483..502: 12-642-387.mis1, potential
  misc_binding 504..523: 12-642-387.mis2, potential complement
  primer_bind 117..135: upstream amplification primer
  primer_bind 592..612: downstream amplification primer, complement
  misc_binding 491..515: 12-642-387 potential probe
  misc_feature 537,804,808,881,899,903,920,936,958,962..963,967,985,995: n=a, g, c or t
tttattcgaatattttactctcattaaacattaagtaatatataattataattttagaaaacctaaaataactcaatattaatgcttatttatgtatatttctaaactgaaaaaaaaacgagattcactgaaaactcaggctgtttatttgagaaggtcagaaatagtgtgtttctactgtgcatttttagaaaacccttttttatttttattttattttttatttccaacatttattgtaaattcagaggtacatgtgcaagaggtataggtttgttacataggtaaaaaaacactcttgtataaacaaatacaatgatatggactatatgtgtccctgtcaagaaaaacagagcaaaacccttcttaaaaatggcaagacacattttattctgactggtgaattaggggatagagactacagtataaattgagctcaactctaattaagacaaaggtaactggggcttttaaagagaaaaccgatatgactaaaaatgacraaaacataaaggagctaggaggttatatgaaaantggaatattacataaaaattcagtgtgaaataattgaaaattattaggtaaggtgggttaggcagtgtatattttgcagtttggcaggatcatattcctttgagccaagacctaccatggaagctagggtggcctttaaagacaaattcatgacctagtgcccatataagctaagctaaacttggcccagtctcttaacatggtgtttatgcaagtcttttgtgttacgtgggagtgtaaaattcaagtccttcatgaaatacaaanatantttcttaatgggaatattctgtgtttcaaaattattaacggtcgtaactgacttcctatccaaaactgtgcancctggtaaaaatccttgnttanaaagacaaaagatgttntccacatgaggcctgnaatatgcttgagttactatttncacnntagnaacaaccctttgtaatgngataataatncacaga

SEQ ID NO: 369 - DNA, 1001 bp, Homo Sapiens
  allele 503: 12-642-417 : polymorphic base A or G
  misc_binding 484..502: 12-642-417.mis1
  misc_binding 504..523: 12-642-417.mis2, potential complement
  primer_bind 87..105: upstream amplification primer
  primer_bind 562..582: downstream amplification primer, complement
  misc_binding 491..515: 12-642-417 potential probe
  misc_feature 507,774,778,851,869,873,890,906,928,932..933,937,955,965,976,981: n=a, g, c or t
ttaagtaatatataattataattttagaaaacctaaaataactcaatattaatgcttatttatgtatatttctaaactgaaaaaaaaacgagattcactgaaaactcaggctgtttatttgagaaggtcagaaatagtgtgtttctactgtgcatttttagaaaacccttttttatttttattttattttttatttccaacatttattgtaaattcagaggtacatgtgcaagaggtataggtttgttacataggtaaaaaaacactcttgtataaacaaatacaatgatatggactatatgtgtccctgtcaagaaaaacagagcaaaacccttcttaaaaatggcaagacacattttattctgactggtgaattaggggatagagactacagtataaattgagctcaactctaattaagacaaaggtaactggggcttttaaagagaaaaccgatatgactaaaaatgacgaaaacataaaggagctaggaggttatatgraaantggaatattacataaaaattcagtgtgaaataattgaaaattattaggtaaggtgggttaggcagtgtatattttgcagtttggcaggatcatattcctttgagccaagacctaccatggaagctagggtggcctttaaagacaaattcatgacctagtgcccatataagctaagctaaacttggcccagtctcttaacatggtgtttatgcaagtcttttgtgttacgtgggagtgtaaaattcaagtccttcatgaaatacaaanatantttcttaatgggaatattctgtgtttcaaaattattaacggtcgtaactgacttcctatccaaaactgtgcancctggtaaaaatccttgnttanaaagacaaaagatgttntccacatgaggcctgnaatatgcttgagttactatttncacnntagnaacaaccctttgtaatgngataataatncacagaataanagaanangatanntccctttanttn

SEQ ID NO: 370 - DNA, 1001 bp, Homo Sapiens
  allele 434: 12-646-429 : polymorphic base C or T
  misc_binding 414..433: 12-646-429.mis1, potential
  misc_binding 435..454: 12-646-429.mis2, potential complement
  primer_bind 6..26: upstream amplification primer
  primer_bind 474..494: downstream amplification primer, complement
  misc_binding 422..446: 12-646-429 potential probe
  misc_feature 31..32,35,59,514: n=a, g, c or t
ctacacttggaaaatatctgtaccccaaatnnganagtcaatataacctggtggttaanagctggcactctggatccagatggccttgattcaagtcttagaaaccactgtataatgatgtgggactggacaagttacttgaacttcatttgactcagcttcctcaccaatgaaatggcaatagttgtcatcacattatcaatatcatgggttgctgaaagaacgaattcattaatattgcaaagcactaacaattgtgtgtacagcaaaataaaattgtactattatcattaaacaagtcaaaaaatttccacaataataattttagtgttcatataattgcataatatattatagtttcaaaacatgctatgtttctaatgcaaatgataaaaatgacagtatttactatttcaagcatgtgggaattaaayttggagcataaaccaagggctgacaaactatggcctcttggctggtcaaatcttgtcagctacttgttttttaaaaaaantaattggtataataatttcacaccacaaaattatacactttaagcatttaatctttatgattcattggcatttaacacatttgaaatgttctgccactaccaccactatctagatccaaattatttttttcacttcaaaaggaagctttacacccattagagagtcatctcgcattctcccattatccgtgccttgcaacctggcattatgtgttggcatcattgtatagcttattgggtatataacttcaacaaagtgttttattttttcttacttctaacatgtcctatttgtttctaaacagcaattttatgatgcataaaattaaacttctatgttctgatttctctgttattaaatatattcagaggtgttctgatttacattgttgtgagttctctccaattttatattgaagtattttcttgagaatggccataaaccaagatcctggaaagctctgaataaggtggggaagtgagtttc

SEQ ID NO: 371 - DNA, 1001 bp, Homo Sapiens
  allele 438: 12-646-433 : polymorphic base G or T
  misc_binding 418..437: 12-646-433.mis1, potential
  misc_binding 439..458: 12-646-433.mis2, potential complement
  primer_bind 6..26: upstream amplification primer
  primer_bind 474..494: downstream amplification primer, complement
  misc_binding 426..450: 12-646-433 potential probe
  misc_feature 31..32,35,59,514: n=a, g, c or t
ctacacttggaaaatatctgtaccccaaatnnganagtcaatataacctggtggttaanagctggcactctggatccagatggccttgattcaagtcttagaaaccactgtataatgatgtgggactggacaagttacttgaacttcatttgactcagcttcctcaccaatgaaatggcaatagttgtcatcacattatcaatatcatgggttgctgaaagaacgaattcattaatattgcaaagcactaacaattgtgtgtacagcaaaataaaattgtactattatcattaaacaagtcaaaaaatttccacaataataattttagtgttcatataattgcataatatattatagtttcaaaacatgctatgtttctaatgcaaatgataaaaatgacagtatttactatttcaagcatgtgggaattaaacttgkagcataaaccaagggctgacaaactatggcctcttggctggtcaaatcttgtcagctacttgttttttaaaaaaantaattggtataataatttcacaccacaaaattatacactttaagcatttaatctttatgattcattggcatttaacacatttgaaatgttctgccactaccaccactatctagatccaaattatttttttcacttcaaaaggaagctttacacccattagagagtcatctcgcattctcccattatccgtgccttgcaacctggcattatgtgttggcatcattgtatagcttattgggtatataacttcaacaaagtgttttattttttcttacttctaacatgtcctatttgtttctaaacagcaattttatgatgcataaaattaaacttctatgttctgatttctctgttattaaatatattcagaggtgttctgatttacattgttgtgagttctctccaattttatattgaagtattttcttgagaatggccataaaccaagatcctggaaagctctgaataaggtggggaagtgagtttc

SEQ ID NO: 372 - DNA, 1001 bp, Homo Sapiens
  allele 503: 12-647-145 : polymorphic base A or G
  misc_binding 483..502: 12-647-145.mis1, potential
  misc_binding 504..523: 12-647-145.mis2, potential complement
  primer_bind 359..378: upstream amplification primer
  primer_bind 788..808: downstream amplification primer, complement
  misc_binding 491..515: 12-647-145 potential probe
  misc_feature 351,951: n=a, g, c or t
gcatcattgtatagcttattgggtatataacttcaacaaagtgttttattttttcttacttctaacatgtcctatttgtttctaaacagcaattttatgatgcataaaattaaacttctatgttctgatttctctgttattaaatatattcagaggtgttctgatttacattgttgtgagttctctccaattttatattgaagtattttcttgagaatggccataaaccaagatcctggaaagctctgaataaggtggggaagtgagtttcagatatatgagtccggtaaaatataacgaaatgagaaagaaagaacaaaatgcaaaggtagaagaaatttattactcacnagttcctaagtgatgttagggatgatgataggaaactgacagaaagtccagaggtggtagagagctcaaccagctgcctagaagtgcgagggggaacccttgtaggaaggcttttattaaggaccttaggtattatttcctaggcttctccrcaggagttgaggaatggctagcttaagggaacacacatgaaggggaaaattatcatatgactctggtattgatcattaggttatatcatggtcatcacctctgtgatgtgttgcgtttctgggtcattaggatgagaaacatgtagactctatctcaaagaagggaagttttaacaaaggcaatagtgacaacctatgactaggtcttaagcaactcatgttaagcctaaaaatcaatgctgaggcaaaacaaacttacgacgagaaggtagacagacattttagaagaaatgtgacctagctgcttctggattggtagtataaaaagtaccatgaatcagcttctaaatgtaacaagaataaatagtgaaaattgtttttagagacaactatgcaaacatattaggagaagttgactgcagtggcatgcacctatagttccagctanctcaggaggctgaggaaggtggattacttgagcccaggagttcaaggcca

SEQ ID NO: 373 - DNA, 751 bp, Homo Sapiens
  allele 251: 12-648-123 : polymorphic base A or G
  misc_binding 231..250: 12-648-123.mis1, potential
  misc_binding 252..271: 12-648-123.mis2, potential complement
  primer_bind 129..147: upstream amplification primer
  primer_bind 607..627: downstream amplification primer, complement
  misc_binding 239..263: 12-648-123 potential probe
  misc_feature 14,23,28,31..32,35,44,49,67,106,113,124: n=a, g, c or t
atttcttttttggngggaaagtncatcnagnnacntgggaattnctcgntttacagaaagaaattgnattttaaaacctcgtaagtagaagggatcacaagtaagnataattntcaaacaaatncaggaaaacaagtctttagcaggagttttctgaagcgtgaagtgagctgctcaagagagtgaccggatcttttctggagaaaagcctggtggacctctcccactgaagtgtgcatgtgcatcctccrcataggacatggtgaggtgatgatgagagtccctcgaagccagttgtacataacacattccatgagggtgccaattttacagtaagatatcagagtaacaggtgtcacccataaacaaacccagaaatatgtaactatacatgtttacttatggattatcagtaggattttgaggacgagttcacagaaattcaaaaccatacaccagtcaaaaccatgcaccaggcttcgggatgtcagcaattcttaccttatgtgatgaaggagtgatttagaagcaaggtttgggaaattctgacaaattttaagataggttagaaataattatacagttgagagaaatatataatatcttcccaatcataagtgacttttccttagtagcataatcaaggaaatgaaattataatgactacattaaagtaatgatttagaaaacctccctgaaataaaaacaagttacttaggagaacaataacaatataaaattaaagagaagt

SEQ ID NO: 374 - DNA, 928 bp, Homo Sapiens
  allele 428: 12-648-300 : polymorphic base C or T
  misc_binding 408..427: 12-648-300.mis1, potential
  misc_binding 429..447: 12-648-300.mis2, complement
  primer_bind 129..147: upstream amplification primer
  primer_bind 607..627: downstream amplification primer, complement
  misc_binding 416..440: 12-648-300 potential probe
  misc_feature 14,23,28,31..32,35,44,49,67,106,113,124: n=a, g, c or t
atttcttttttggngggaaagtncatcnagnnacntgggaattnctcgntttacagaaagaaattgnattttaaaacctcgtaagtagaagggatcacaagtaagnataattntcaaacaaatncaggaaaacaagtctttagcaggagttttctgaagcgtgaagtgagctgctcaagagagtgaccggatcttttctggagaaaagcctggtggacctctcccactgaagtgtgcatgtgcatcctccgcataggacatggtgaggtgatgatgagagtccctcgaagccagttgtacataacacattccatgagggtgccaattttacagtaagatatcagagtaacaggtgtcacccataaacaaacccagaaatatgtaactatacatgtttacttatggattatcagtaggattttgaggaygagttcacagaaattcaaaaccatacaccagtcaaaaccatgcaccaggcttcgggatgtcagcaattcttaccttatgtgatgaaggagtgatttagaagcaaggtttgggaaattctgacaaattttaagataggttagaaataattatacagttgagagaaatatataatatcttcccaatcataagtgacttttccttagtagcataatcaaggaaatgaaattataatgactacattaaagtaatgatttagaaaacctccctgaaataaaaacaagttacttaggagaacaataacaatataaaattaaagagaagtaaacagtggtagtcttcctaagaatctatattagtgattacaagagcttggttcccatatttttaactgtatctttccctcactactgtgtaaagatactaatttatttcttactttacatacttaatcaaatacatacacacacacacgcacatgcacacacttacataactacag

SEQ ID NO: 375 - DNA, 1001 bp, Homo Sapiens
  allele 501: 12-648-402 : polymorphic base G or C
  misc_binding 481..500: 12-648-402.mis1, potential
  misc_binding 502..521: 12-648-402.mis2, potential complement
  primer_bind 100..118: upstream amplification primer
  primer_bind 578..598: downstream amplification primer, complement
  misc_binding 489..513: 12-648-402 potential probe
  misc_feature 2..3,6,15,20,38,77,84,95,910..911,996..997: n=a, g, c or t
gnnacntgggaattnctcgntttacagaaagaaattgnattttaaaacctcgtaagtagaagggatcacaagtaagnataattntcaaacaaatncaggaaaacaagtctttagcaggagttttctgaagcgtgaagtgagctgctcaagagagtgaccggatcttttctggagaaaagcctggtggacctctcccactgaagtgtgcatgtgcatcctccgcataggacatggtgaggtgatgatgagagtccctcgaagccagttgtacataacacattccatgagggtgccaattttacagtaagatatcagagtaacaggtgtcacccataaacaaacccagaaatatgtaactatacatgtttacttatggattatcagtaggattttgaggacgagttcacagaaattcaaaaccatacaccagtcaaaaccatgcaccaggcttcgggatgtcagcaattcttaccttatgtgatgaaggagtgatttagaagsaaggtttgggaaattctgacaaattttaagataggttagaaataattatacagttgagagaaatatataatatcttcccaatcataagtgacttttccttagtagcataatcaaggaaatgaaattataatgactacattaaagtaatgatttagaaaacctccctgaaataaaaacaagttacttaggagaacaataacaatataaaattaaagagaagtaaacagtggtagtcttcctaagaatctatattagtgattacaagagcttggttcccatatttttaactgtatctttccctcactactgtgtaaagatactaatttatttcttactttacatacttaatcaaatacatacacacacacacgcacatgcacacacttacataactacagattaataatanngagaaaattgatgttgtataacataagtctttccaaaggaactgagcgatgtcgtatttaaaaaactggcactactagaagtcanngtat

SEQ ID NO: 376 - DNA, 798 bp, Homo Sapiens
  allele 298: 12-652-115 : polymorphic base C or T
  misc_binding 278..297: 12-652-115.mis1, potential
  misc_binding 299..318: 12-652-115.mis2, potential complement
  primer_bind 184..203: upstream amplification primer
  primer_bind 615..635: downstream amplification primer, complement
  misc_binding 286..310: 12-652-115 potential probe
  misc_feature 43..44,341: n=a, g, c or t
aaataattggttaaaaatttttatgccacaaaattaaacactnnaaccatttaatgtgtacaattcattggcgtttaatatatttgcaatattttgccactaccaccactctctagatccaaagtattttgtcacttcaaaaggaagctttatacccattagacagtcatctcgcattctcccatcctccatctcctgcaacctggcattatctgttggcatcattctatagcctagtagataatgtttttttaaaggcaaataggtacataacttcaacaaagtgttttatttttcyttatttttacatctcctatttgttcctaaatgaaaattctgtngatgtataagaattagttattatttcctagttgctctgttattaaatatattcagcagtgttgtgatttatattgttacagtttctgtccaattttgtattgaagtctgtccctttagaattgcaataaaccaagctctgatggaggtgaggaagtgaaattcagatgtgtgtgtcaggtaaaatacaatgaaatgtaaaataaaaccaaaatgcatgaaatagaagaaatgtattacagttcctagagatattaaggataatgacataaaacggacagaaaattcagaagtggcagagagctcaaccagctgcctggaagtgatagagagaatccctgtgtggggggctgtgggggtgcttttcttaaggtctatgagcattatttcctagtcttgtctgccggagttgtggagtggctatcttaagaaaacacacatgaagagggaaaattatta

SEQ ID NO: 377 - DNA, 886 bp, Homo Sapiens
  allele 386: 12-652-203 : polymorphic base A or C
  misc_binding 367..385: 12-652-203.mis1
  misc_binding 387..406: 12-652-203.mis2, potential complement
  primer_bind 184..203: upstream amplification primer
  primer_bind 615..635: downstream amplification primer, complement
  misc_binding 374..398: 12-652-203 potential probe
  misc_feature 43..44,341: n=a, g, c or t
aaataattggttaaaaatttttatgccacaaaattaaacactnnaaccatttaatgtgtacaattcattggcgtttaatatatttgcaatattttgccactaccaccactctctagatccaaagtattttgtcacttcaaaaggaagctttatacccattagacagtcatctcgcattctcccatcctccatctcctgcaacctggcattatctgttggcatcattctatagcctagtagataatgtttttttaaaggcaaataggtacataacttcaacaaagtgttttatttttctttatttttacatctcctatttgttcctaaatgaaaattctgtngatgtataagaattagttattatttcctagttgctctgttattamatatattcagcagtgttgtgatttatattgttacagtttctgtccaattttgtattgaagtctgtccctttagaattgcaataaaccaagctctgatggaggtgaggaagtgaaattcagatgtgtgtgtcaggtaaaatacaatgaaatgtaaaataaaaccaaaatgcatgaaatagaagaaatgtattacagttcctagagatattaaggataatgacataaaacggacagaaaattcagaagtggcagagagctcaaccagctgcctggaagtgatagagagaatccctgtgtggggggctgtgggggtgcttttcttaaggtctatgagcattatttcctagtcttgtctgccggagttgtggagtggctatcttaagaaaacacacatgaagagggaaaattattatttgattctggtgttgaccattaggttatctcatggtaatcagctctgtggtatgttgcatttctgggtcagtgggatgagaaacaag

SEQ ID NO: 378 - DNA, 957 bp, Homo Sapiens
  allele 457: 12-652-274 : polymorphic base G or T
  misc_binding 437..456: 12-652-274.mis1, potential
  misc_binding 458..477: 12-652-274.mis2, potential complement
  primer_bind 184..203: upstream amplification primer
  primer_bind 615..635: downstream amplification primer, complement
  misc_binding 445..469: 12-652-274 potential probe
  misc_feature 43..44,341: n=a, g, c or t
aaataattggttaaaaatttttatgccacaaaattaaacactnnaaccatttaatgtgtacaattcattggcgtttaatatatttgcaatattttgccactaccaccactctctagatccaaagtattttgtcacttcaaaaggaagctttatacccattagacagtcatctcgcattctcccatcctccatctcctgcaacctggcattatctgttggcatcattctatagcctagtagataatgtttttttaaaggcaaataggtacataacttcaacaaagtgttttatttttctttatttttacatctcctatttgttcctaaatgaaaattctgtngatgtataagaattagttattatttcctagttgctctgttattaaatatattcagcagtgttgtgatttatattgttacagtttctgtccaattttgtattgaagtctgtcccttkagaattgcaataaaccaagctctgatggaggtgaggaagtgaaattcagatgtgtgtgtcaggtaaaatacaatgaaatgtaaaataaaaccaaaatgcatgaaatagaagaaatgtattacagttcctagagatattaaggataatgacataaaacggacagaaaattcagaagtggcagagagctcaaccagctgcctggaagtgatagagagaatccctgtgtggggggctgtgggggtgcttttcttaaggtctatgagcattatttcctagtcttgtctgccggagttgtggagtggctatcttaagaaaacacacatgaagagggaaaattattatttgattctggtgttgaccattaggttatctcatggtaatcagctctgtggtatgttgcatttctgggtcagtgggatgagaaacaagtgtactctgtaacaaacaactacacaaggaagggaagtttcacaaagccaaaagtgacaggctatgacttg

SEQ ID NO: 379 - DNA, 1001 bp, Homo Sapiens
  allele 501: 12-652-371 : polymorphic base C or T
  misc_binding 481..500: 12-652-371.mis1, potential
  misc_binding 502..521: 12-652-371.mis2, potential complement
  primer_bind 131..150: upstream amplification primer
  primer_bind 562..582: downstream amplification primer, complement
  misc_binding 489..513: 12-652-371 potential probe
  misc_feature 288: n=a, g, c or t
atgtgtacaattcattggcgtttaatatatttgcaatattttgccactaccaccactctctagatccaaagtattttgtcacttcaaaaggaagctttatacccattagacagtcatctcgcattctcccatcctccatctcctgcaacctggcattatctgttggcatcattctatagcctagtagataatgtttttttaaaggcaaataggtacataacttcaacaaagtgttttatttttctttatttttacatctcctatttgttcctaaatgaaaattctgtngatgtataagaattagttattatttcctagttgctctgttattaaatatattcagcagtgttgtgatttatattgttacagtttctgtccaattttgtattgaagtctgtccctttagaattgcaataaaccaagctctgatggaggtgaggaagtgaaattcagatgtgtgtgtcaggtaaaatacaatgaaatgtaaaataaaaccaaaaygcatgaaatagaagaaatgtattacagttcctagagatattaaggataatgacataaaacggacagaaaattcagaagtggcagagagctcaaccagctgcctggaagtgatagagagaatccctgtgtggggggctgtgggggtgcttttcttaaggtctatgagcattatttcctagtcttgtctgccggagttgtggagtggctatcttaagaaaacacacatgaagagggaaaattattatttgattctggtgttgaccattaggttatctcatggtaatcagctctgtggtatgttgcatttctgggtcagtgggatgagaaacaagtgtactctgtaacaaacaactacacaaggaagggaagtttcacaaagccaaaagtgacaggctatgacttgctcttaaacaactcaagttaagtctaaaaatggatgtggaatcaataactatattcaacaaatgtatgacaagaaggtagaaaagggatgggtccag

SEQ ID NO: 380 - DNA, 1001 bp, Homo Sapiens
  allele 499: 12-653-423 : polymorphic base T or A
  misc_binding 479..498: 12-653-423.mis1, potential
  misc_binding 500..519: 12-653-423.mis2, potential complement
  primer_bind 903..921: upstream amplification primer, complement
  primer_bind 390..410: downstream amplification primer
  misc_binding 487..511: 12-653-423 potential probe
aaaaactgtgtaaaaactgttatctccagagaaaaaccaatgctaaggaagcatccagtgtagataatagagagtatcctggagtcactgatattaataatttagatgagagctgaactatatgcaggaataggtaaaagaatgaagaagagaaaaaaacacaaaaagaaaagcaggtaaagtgttcaggacagttctcaagactcaaagtttagtttgcaaggaagatactgagtaagaatcagatgatgctgataggcaagataagagccagatactcctcaggagttgaaatatttattaagcacatttagggactactaaaaagagttaagaaaagaaaatatgggataagattatactttttaaaaaaagattccaagatgttcgatggattaaattgtggaagggccaaactagaaagagctgaccattgaggaaattttgtatgaattcaggtagcagatgatggaaaaatggactagaaagtggatagaawtacctatgcctacttttacagtaatatgactaacttcatattgtgttgtgtggaaaaaagttaatacaaataaaccacttaaaatgtctctggcatatagttagtgattcagaaatattattttgcaattatggttatttttgttattactaatactatgaattacttaacatgtgtaagtcacttgagatattattcctcatttaatagaaactaattattcagcatttcaagattatattctctaacaaagtcctatggtcttctatatgacagataccctgtagacttgtttaaaataagacatatcagttttgacagtaagatgagcaaaatgaaattgtaaaattctaccacaagtgacaaggatcttcatcagtattctaacttataagaaaataatcccttaccgatataaatgtgtgattctattagtatttgcagccagacccagtgttcacttgattttactaaagcatttaaatcattctgcgttgagatc

SEQ ID NO: 381 - DNA, 1001 bp, Homo Sapiens
  allele 499: 12-654-115 : polymorphic base T or C
  misc_binding 479..498: 12-654-115.mis1, potential
  misc_binding 500..519: 12-654-115.mis2, potential complement
  primer_bind 595..613: upstream amplification primer, complement
  primer_bind 76..96: downstream amplification primer
  misc_binding 487..511: 12-654-115 potential probe
ccatcaggaagacccactacgttatctgagacaatggcaaaagctgacatatggcttattcgaaactactgggattttcaatttcctcacccactcttaccaaatgttgagttcgttggaggactccactgcaaacctgccaaacccctaccgaaggtaaactattactgtttgttttgtctgctttgaagtttcagtacgaatggttctatattcattcaaagtgtttgacttacactggaagaaaggtggaagtgggaagagtaaagcagataccaattagaaactgacgtacatgttgatactatcacaagtttatgaatttcatcattattaccaataaagagggatactaaagagactttgaaaatagggttggtaaattaaagctttgattatgcaacatgtaagaaggtactggccattcattcaaagaatatttataaagagattagcacacaccacaggtacgtgtatgggacacagtttctatcccaayacaccttacattctattttgaaagatagaatatatgcaagtaataaaaactgtgtaaaaactgttatctccagagaaaaaccaatgctaaggaagcatccagtgtagataatagagagtatcctggagtcactgatattaataatttagatgagagctgaactatatgcaggaataggtaaaagaatgaagaagagaaaaaaacacaaaaagaaaagcaggtaaagtgttcaggacagttctcaagactcaaagtttagtttgcaaggaagatactgagtaagaatcagatgatgctgataggcaagataagagccagatactcctcaggagttgaaatatttattaagcacatttagggactactaaaaagagttaagaaaagaaaatatgggataagattatactttttaaaaaaagattccaagatgttcgatggattaaattgtggaagggccaaactagaaagagctgaccattgaggaaattttgtatgaattcag

SEQ ID NO: 382 - DNA, 1001 bp, Homo Sapiens
  allele 499: 12-654-207 : polymorphic base G or A
  misc_binding 479..498: 12-654-207.mis1, potential
  misc_binding 500..519: 12-654-207.mis2, potential complement
  primer_bind 687..705: upstream amplification primer, complement
  primer_bind 168..188: downstream amplification primer
  misc_binding 487..511: 12-654-207 potential probe
tgcctacatttttgcccacattattctaacttctttcagaaaattacctagtttaattatcttgtgtcatctatcttttctttttttttcccccatcaggaagacccactacgttatctgagacaatggcaaaagctgacatatggcttattcgaaactactgggattttcaatttcctcacccactcttaccaaatgttgagttcgttggaggactccactgcaaacctgccaaacccctaccgaaggtaaactattactgtttgttttgtctgctttgaagtttcagtacgaatggttctatattcattcaaagtgtttgacttacactggaagaaaggtggaagtgggaagagtaaagcagataccaattagaaactgacgtacatgttgatactatcacaagtttatgaatttcatcattattaccaataaagagggatactaaagagactttgaaaatagggttggtaaattaaagctttgattatgcaacatrtaagaaggtactggccattcattcaaagaatatttataaagagattagcacacaccacaggtacgtgtatgggacacagtttctatcccaatacaccttacattctattttgaaagatagaatatatgcaagtaataaaaactgtgtaaaaactgttatctccagagaaaaaccaatgctaaggaagcatccagtgtagataatagagagtatcctggagtcactgatattaataatttagatgagagctgaactatatgcaggaataggtaaaagaatgaagaagagaaaaaaacacaaaaagaaaagcaggtaaagtgttcaggacagttctcaagactcaaagtttagtttgcaaggaagatactgagtaagaatcagatgatgctgataggcaagataagagccagatactcctcaggagttgaaatatttattaagcacatttagggactactaaaaagagttaagaaaagaaaatatgggataagattatactttt

SEQ ID NO: 383 - DNA, 1001 bp, Homo Sapiens
  allele 503: 12-657-396 : polymorphic base A or G
  misc_binding 483..502: 12-657-396.mis1, potential
  misc_binding 504..523: 12-657-396.mis2, potential complement
  primer_bind 108..128: upstream amplification primer
  primer_bind 566..586: downstream amplification primer, complement
  misc_binding 491..515: 12-657-396 potential probe
  misc_feature 74,84,232,860,993: n=a, g, c or t
ctgtataattatcgggttgtgtgctgcttctagtaaataattattatatactgaagctatatgtttctaacacnaaactttatnaatttctgttctaacatgcatctcagaatatagggacaatatagctatatgtatgacaacttcaaaattttattttaaaagtatacataaactatattattttatgtggtattgcatctttataatgaagacaattttttctctggangaaaatggaagaatttgcccagagctctgatgaagacggtgttgtgttttctctggagtcagctgtgcaaaaccttacagaagaaaaagctgatcttatcacttcggccctggctcagattccacaaaaagtcagtacaacctccaatccttataagaaactattcacacaatggagaaagtatggctttccacctggaacttgaatctcatttttcaatttgcataacaggcactagatttatgtaacaatttggaaagtattatggtartttatgtgagcacaactgattatttgtctagtgatctttgctattactttagtaacacatctcttggttgtcgtttgttaataataaagtaaaaataaagcattaagtccctatttcacgttgcaggatttgaaatcttaagacctattctgatgactccaaaggaaacttcttaagtatactagctcaaaggaacctaaactttgggggatgatataagaaagatagagaagaatcatgctcaatattatcttcaacatattttattgtataggagctctattcagtgtgtttgaacataaaagtagaagcttagatttatgtagtctttctaatgaactggagttttctatagtntacaaggcaattatgattttaatattacagtctaacaacctgcatgtaatactttatgatattcaattaattttattactgtaattctagttttcctctctttagttagtgctatttatacactagcctcaangggttact

SEQ ID NO: 384 - DNA, 1001 bp, Homo Sapiens
  allele 503: 12-658-120 : polymorphic base A or T
  misc_binding 483..502: 12-658-120.mis1, potential
  misc_binding 504..523: 12-658-120.mis2, potential complement
  primer_bind 384..404: upstream amplification primer
  primer_bind 863..883: downstream amplification primer, complement
  misc_binding 491..515: 12-658-120 potential probe
  misc_feature 418,551: n=a, g, c or t
atttttcaatttgcataacaggcactagatttatgtaacaatttggaaagtattatggtagtttatgtgagcacaactgattatttgtctagtgatctttgctattactttagtaacacatctcttggttgtcgtttgttaataataaagtaaaaataaagcattaagtccctatttcacgttgcaggatttgaaatcttaagacctattctgatgactccaaaggaaacttcttaagtatactagctcaaaggaacctaaactttgggggatgatataagaaagatagagaagaatcatgctcaatattatcttcaacatattttattgtataggagctctattcagtgtgtttgaacataaaagtagaagcttagatttatgtagtctttctaatgaactggagttttctatagtntacaaggcaattatgattttaatattacagtctaacaacctgcatgtaatactttatgatattcaattaattttattactgtaawtctagttttcctctctttagttagtgctatttatacactagcctcaangggttactttttaaaattttatgtttaaatttcaaaacactcaataaaagccagtatgctaattaggaatgtgaaattagttttgattatgagattctctttttgggagttcagaatatctatgtaatcctttgttttcaagtgtaagattttcatataggtttccagaaagaaaaaagtatggaattaaggtacaaatacaaacaaaattcagccttgaacaatgaagtataggtaacttctgtctctttcttttttgattaaaaataaatgaaataaaggagagaatgaagcataaagagaaaagacaaccaactatccaaaaccagacaaaagccaaagcaatgtttgtctctgggaaactgtaaatttgataatagagctagaatggccaagtgatttacatttacacagcagttgtgtgtccacaaggatatttaacttccatat

SEQ ID NO: 385 - DNA, 1001 bp, Homo Sapiens
  allele 501: 12-659-382 : polymorphic base A or G
  misc_binding 481..500: 12-659-382.mis1, potential
  misc_binding 502..521: 12-659-382.mis2, potential complement
  primer_bind 120..139: upstream amplification primer
  primer_bind 552..572: downstream amplification primer, complement
  misc_binding 489..513: 12-659-382 potential probe
  misc_feature 21,546: n=a, g, c or t
atattgagataataaatgaancattcaaatatttaagtaatcattaggcagacataattccagtgtaaagatgagtaaaaaattactaatggtccccaccctttttattaatgtatttactacattcactttcaacttccaaataatgttaagcttttcatttctaaagcaatgaaaagggagtgagtttacttatattcacttgtttcataagttatattcccatatctgatgatttacaaagaaagcaaatctatcaatcatctatgtctgagaaatacattaatctgcttaaaaggcacatataatttgtttccgattacaaattattaagcactttttccaagaaaaaaattcaagtgactttttttcccatatgtgcagaataatatcgcatgtgctacaattggaaattatttaaaggtggaaaagactgattggcagttctttaataataggtctgtttaaaatatcccaaatttgtggtgatgctaaatttcrttctgctggctcttaactcttcagtggcacaatccaaagcgttgncagcagtggtttatatggtctgctatagctaagccatgtagtacatgcctagtaccaacatgtggtactgattttggaattaccaagcaatcttcataaactagtgtataatctacaagtttttaacgtgtacttgctatctgagttttaaaagtaactacacatttgcatcaaaaaattagtataggtgattacaagaatgttatacaggatataaaactaaaaactgctttataaatattcaaatatcaaagttgctgcatcagctcagagacgctgaagctgtgctggaggcagcagagttaatggcggcaagtccctgtggagggaccttcactaacccacattcctccttcctgccctccatccttcccgatctcccgctcctcttggtgtcatttcttactgcaatagagttttgcgtccacatacctacctagggctattattaacaa

SEQ ID NO: 386 - DNA, 983 bp, Homo Sapiens
  allele 306: 12-660-134 : polymorphic base A or G
  misc_binding 286..305: 12-660-134.mis1, potential
  misc_binding 307..326: 12-660-134.mis2, potential complement
  primer_bind 173..193: upstream amplification primer
  primer_bind 692..712: downstream amplification primer, complement
  misc_binding 294..318: 12-660-134 potential probe
  misc_feature 880..881,889,925..926,930: n=a, g, c or t
agtgtagttacatctcacaaataattttttcaatcattttctgggttgtctgtctactaattcaaatgttacacctacctttttctcctaatagctagatattccaaatgtaactgaaatataacagcccttcttttattaccagtgacagcactttttatgggaataaatccccagtctttattatgaagtggtaacacattttgtcatggagtgtggcctgtccttctactactggagcatcaccaccaccccactccctgctgccgtggacaccatgccctatcacactcagtgacttcactrtttctctaagagaatatgttctagcatgcatcctgctttttgggggctagagtgggggatatgcagttttttttgtctgcagtgtgctctttctatttgtccacttgacaatcttgtattcattcttcaagtctcaagtcacataccacttcttcaatatgtagccatcacttatcgccccagaggacttggtgcttctttctctgagatctgaaagtaattttaatgcagttttactgttacagtaatttgttacctagagaaccatgcccatttcattgcctcatattgagcattgctcattttaagactcaccacgaataattattcaaaaatttatctaatcctaggtcatctaacaaccaaagcttttatacctcatggtggaggcaatgacatctatgagaggatctaccatgggatccctatggtgggccttcctttgtttgtagatcaacccgataagttggttcacatgaaggctaagggggaagctgttacagtagactcaaaaacgatgtcatctacaaatttgctcaatgcataaaaagcagtcattaatgactcttcatgnntgtaattnttttaactacgtagcatgtatttgctgactacattnntttntggtaatgcttaaaggcaatcgtcaattaaccactatgagtatcacgatctgt

SEQ ID NO: 387 - DNA, 1000 bp, Homo Sapiens
  allele 497: 12-662-80 : polymorphic base G or C
  misc_binding 477..496: 12-662-80.mis1, potential
  misc_binding 498..517: 12-662-80.mis2, potential complement
  primer_bind 418..435: upstream amplification primer
  primer_bind 979..1000: downstream amplification primer, complement
  misc_binding 485..509: 12-662-80 potential probe
  misc_feature 24,726,739: n=a, g, c or t
atatagtcagtgactcagaaatgnttattaattttgcaattatggttattttattactaatactactaactacttaacatgtgcatgtcacttgagatatcattcctcatttaagagaaccagattattcagcacatcaaggttatattgtcttggaaagtcatagatgacagatacccttggacttgattaaaagtagacatatcagttgtgacagcaagataagctagttgaaattttaaaattcttccataagtaataaggatcttcaccagtattccagcttaaaacacttcctcaacaatataaatgtgtgcctcaaatatgtgcagacaaacacagggttcacatgattttaataaagcatttaaatcattctgcattgagatcccagaattttacattttagagcataaacatatcctattagagcagatgatttctgccttatgacaggccactcaataaagcttcctgggggaactcgtcttgacatsataggtgtctgacagagaagcacagagataatgaacaatgcatgtataataaagaccaaataatttctgccacttgtttctgaatagtgcccttagtttcaatacgaaaaaaaattccgtcagcatataagattatattcttttcgaaggaatacaagaacttcatatattttaattaacatcacattttaaggcatatgtaaaaagtaaggcttcttcaatggattanttatgcaatctcnttaaaagatcatttttgcttgcataaaactgagaatttgttccattgttaaaactcagtatctatgtttaatgcaagttgtataggctttatagagtcagtttcttaagagacaaaagttgaggtaagactaatgaaaaatatataccactctaccctactcttgaaagatttccccactcacactaagggaaactgacagtgccagtagaaggaggaagagagtaagacaatgtagaaggacaagaaaaaaaggttgact

SEQ ID NO: 388 - DNA, 1001 bp, Homo Sapiens
  allele 501: 12-906-149 : polymorphic base A or G
  misc_binding 482..500: 12-906-149.mis1
  misc_binding 502..521: 12-906-149.mis2, potential complement
  primer_bind 353..372: upstream amplification primer
  primer_bind 809..829: downstream amplification primer, complement
  misc_binding 489..513: 12-906-149 potential probe
  misc_feature 750,853..854,860,942,945: n=a, g, c or t
taattttataactgattgccaggttgttaagcctggcaagacattcagagctaggtcaacaaatatttcatttttttctgttttatcctgtggcatatggaccacctcaaatttcagtgcagaaggcttcctgtagtcaattaacaaagactttgagtgagtcaatactgttacctcatggcccctcactatgatctcctctagaatgaccttgacattaagccaatggctcatgtcacagggccacaccaggaccttctcacagaattcacaactagcacagaagagttgcaggagccgaaataccaaagctgacttctcgggcctcatgatgacatttccctcacacactgatctgcactagctttgtagttactaagcatgaaattgaaatgacaatataagcacagaagttaaaaattaatattttaagtgtaaataaagttcattggttggttgccagcttcacatttattgaagatatcaaaaagaaatgcaatrttgcaatgtatcagggaaaatttgttccaaccttctagagcttagaaataaaacacataaagatacttttattatctggattgatgataaagaaattttttaaaattctttagatttaataattcatgtgcagaaacatatgcacacaaccacatttacattcattccacactaaatccaaggtgtcagatggtttagaagaactcatgtttcacatcctttgctcacaaggacaatacaaagaattanctgggaatacacttggagactttgggtaactattttcattaattctatatactaagtgcaaagtgttcagtatttcagaggagaaaaatgcacaattgctttnnaatatnctgataattaataaaagctttagtaagacatttgacttaggaggtgagatgaaagcttcattaggatttattgttgccaaanggnaagcatttcacaatcaatacaagcatgacgaaagtataggatatttaaaagtcatt

SEQ ID NO: 389 - DNA, 1001 bp, Homo Sapiens
  allele 501: 12-906-154 : polymorphic base A or C
  misc_binding 481..500: 12-906-154.mis1, potential
  misc_binding 502..521: 12-906-154.mis2, potential complement
  primer_bind 348..367: upstream amplification primer
  primer_bind 804..824: downstream amplification primer, complement
  misc_binding 489..513: 12-906-154 potential probe
  misc_feature 745,848..849,855,937,940: n=a, g, c or t
ttataactgattgccaggttgttaagcctggcaagacattcagagctaggtcaacaaatatttcatttttttctgttttatcctgtggcatatggaccacctcaaatttcagtgcagaaggcttcctgtagtcaattaacaaagactttgagtgagtcaatactgttacctcatggcccctcactatgatctcctctagaatgaccttgacattaagccaatggctcatgtcacagggccacaccaggaccttctcacagaattcacaactagcacagaagagttgcaggagccgaaataccaaagctgacttctcgggcctcatgatgacatttccctcacacactgatctgcactagctttgtagttactaagcatgaaattgaaatgacaatataagcacagaagttaaaaattaatattttaagtgtaaataaagttcattggttggttgccagcttcacatttattgaagatatcaaaaagaaatgcaatgttgcmatgtatcagggaaaatttgttccaaccttctagagcttagaaataaaacacataaagatacttttattatctggattgatgataaagaaattttttaaaattctttagatttaataattcatgtgcagaaacatatgcacacaaccacatttacattcattccacactaaatccaaggtgtcagatggtttagaagaactcatgtttcacatcctttgctcacaaggacaatacaaagaattanctgggaatacacttggagactttgggtaactattttcattaattctatatactaagtgcaaagtgttcagtatttcagaggagaaaaatgcacaattgctttnnaatatnctgataattaataaaagctttagtaagacatttgacttaggaggtgagatgaaagcttcattaggatttattgttgccaaanggnaagcatttcacaatcaatacaagcatgacgaaagtataggatatttaaaagtcattccagt

SEQ ID NO: 390 - DNA, 1001 bp, Homo Sapiens
  allele 501: 12-906-251 : polymorphic base A or T
  misc_binding 481..500: 12-906-251.mis1, potential
  misc_binding 502..521: 12-906-251.mis2, potential complement
  primer_bind 251..270: upstream amplification primer
  primer_bind 707..727: downstream amplification primer, complement
  misc_binding 489..513: 12-906-251 potential probe
  misc_feature 648,751..752,758,840,843: n=a, g, c or t
cacctcaaatttcagtgcagaaggcttcctgtagtcaattaacaaagactttgagtgagtcaatactgttacctcatggcccctcactatgatctcctctagaatgaccttgacattaagccaatggctcatgtcacagggccacaccaggaccttctcacagaattcacaactagcacagaagagttgcaggagccgaaataccaaagctgacttctcgggcctcatgatgacatttccctcacacactgatctgcactagctttgtagttactaagcatgaaattgaaatgacaatataagcacagaagttaaaaattaatattttaagtgtaaataaagttcattggttggttgccagcttcacatttattgaagatatcaaaaagaaatgcaatgttgcaatgtatcagggaaaatttgttccaaccttctagagcttagaaataaaacacataaagatacttttattatctggattgatgataaagaaattttttwaaattctttagatttaataattcatgtgcagaaacatatgcacacaaccacatttacattcattccacactaaatccaaggtgtcagatggtttagaagaactcatgtttcacatcctttgctcacaaggacaatacaaagaattanctgggaatacacttggagactttgggtaactattttcattaattctatatactaagtgcaaagtgttcagtatttcagaggagaaaaatgcacaattgctttnnaatatnctgataattaataaaagctttagtaagacatttgacttaggaggtgagatgaaagcttcattaggatttattgttgccaaanggnaagcatttcacaatcaatacaagcatgacgaaagtataggatatttaaaagtcattccagtgagtagtgatcacagagaaagttcagggcaggacgttacagaacaaagttagtttgaaataggagaaattagttttaaataaacaattattagtctg

SEQ ID NO: 391 - DNA, 1001 bp, Homo Sapiens
  allele 501: 12-906-451 : polymorphic base A or C
  misc_binding 481..500: 12-906-451.mis1, potential
  misc_binding 502..521: 12-906-451.mis2, potential complement
  primer_bind 52..71: upstream amplification primer
  primer_bind 508..528: downstream amplification primer, complement
  misc_binding 489..513: 12-906-451 potential probe
  misc_feature 449,552..553,559,641,644: n=a, g, c or t
aataccaaagctgacttctcgggcctcatgatgacatttccctcacacactgatctgcactagctttgtagttactaagcatgaaattgaaatgacaatataagcacagaagttaaaaattaatattttaagtgtaaataaagttcattggttggttgccagcttcacatttattgaagatatcaaaaagaaatgcaatgttgcaatgtatcagggaaaatttgttccaaccttctagagcttagaaataaaacacataaagatacttttattatctggattgatgataaagaaattttttaaaattctttagatttaataattcatgtgcagaaacatatgcacacaaccacatttacattcattccacactaaatccaaggtgtcagatggtttagaagaactcatgtttcacatcctttgctcacaaggacaatacaaagaattanctgggaatacacttggagactttgggtaactattttcattaattctatatamtaagtgcaaagtgttcagtatttcagaggagaaaaatgcacaattgctttnnaatatnctgataattaataaaagctttagtaagacatttgacttaggaggtgagatgaaagcttcattaggatttattgttgccaaanggnaagcatttcacaatcaatacaagcatgacgaaagtataggatatttaaaagtcattccagtgagtagtgatcacagagaaagttcagggcaggacgttacagaacaaagttagtttgaaataggagaaattagttttaaataaacaattattagtctgaatgataatttataggtaaataattacttactcaagttttaaaggacagtcacaagatcgagcttttccttagcaagaaattcttgcatctcaacatagagtgatatgtaaagataagagtttagaaacagggaaaatgataaaaattgtatattagttactgagacatgtcaaccttatggaataaaacataaattgt

SEQ ID NO: 392 - DNA, 744 bp, Homo Sapiens
  allele 244: 12-907-199 : polymorphic base G or T
  misc_binding 224..243: 12-907-199.mis1, potential
  misc_binding 245..263: 12-907-199.mis2, complement
  primer_bind 46..65: upstream amplification primer
  primer_bind 533..553: downstream amplification primer, complement
  misc_binding 232..256: 12-907-199 potential probe
tgactttaggaacatttagaaagtttaaagtaaacaatgctcaatgtaattgagcatgaggagtggttgaattatgatttaaaaccagccttgtctttttttatagtgacttgaagaggtttagtaattccttcatgttttggaccgagaccgattccaggaacaaacgtcatgttttccattatatatagactgggaacactataagagctatgtggaatattaattgcagccccccattgtkccagctaatctctgcctcaaagattaatggggattggtgtgatataaggctgaattgtaccttttgaccatcagggccagtgcaaggcaagataaatgtgctctggtgaacttcatcagcttttccaacccctacttatcccatgttagtgggatgtttaagccagaaggaaggccatacattagaggaaataatagaaacatcagccccagcatccactatgccctcaaacctttttccttgaatgtgtatggtgcaggtgggccattgtttagaaattactttaatccaataagcggctttttcactgttggagcctatcccagagccccctgtcttatctcctttgtttaaaacaatattaggtaataaaagtaattgagcaattgactcaccaactggaatggaaacaggaaccttggcagacaccataagtttaatctcatcagaggaatcagaattaatgagaccagtaggaactatgatacctttagcagagg

SEQ ID NO: 393 - DNA, 1001 bp, Homo Sapiens
  allele 501: 12-907-482 : polymorphic base A or T
  misc_binding 481..500: 12-907-482.mis1, potential
  misc_binding 502..521: 12-907-482.mis2, potential complement
  primer_bind 20..39: upstream amplification primer
  primer_bind 507..527: downstream amplification primer, complement
  misc_binding 489..513: 12-907-482 potential probe
aaagtaaacaatgctcaatgtaattgagcatgaggagtggttgaattatgatttaaaaccagccttgtctttttttatagtgacttgaagaggtttagtaattccttcatgttttggaccgagaccgattccaggaacaaacgtcatgttttccattatatatagactgggaacactataagagctatgtggaatattaattgcagccccccattgttccagctaatctctgcctcaaagattaatggggattggtgtgatataaggctgaattgtaccttttgaccatcagggccagtgcaaggcaagataaatgtgctctggtgaacttcatcagcttttccaacccctacttatcccatgttagtgggatgtttaagccagaaggaaggccatacattagaggaaataatagaaacatcagccccagcatccactatgccctcaaacctttttccttgaatgtgtatggtgcaggtgggccattgtttagaaattacwttaatccaataagcggctttttcactgttggagcctatcccagagccccctgtcttatctcctttgtttaaaacaatattaggtaataaaagtaattgagcaattgactcaccaactggaatggaaacaggaaccttggcagacaccataagtttaatctcatcagaggaatcagaattaatgagaccagtaggaactatgatacctttagcagaggtggatgtcctacctaacaccaggcccatggaaccttgaggtaaagggccagtgacccctgtggggacaattaaaagacaagaattaggtagtaaatttagaggaatggtactatggagatcaaccaccctgccccctactgtggaggtagacaagcagtgtactgtgacagaagaagaggctgggacccatctgggtttgctgtaggtaaatttgtttgtactgggggctgcgttaggaccgcttcaattggaaatgcaacattggtctgagtctgaggtgtg

SEQ ID NO: 394 - DNA, 1001 bp, Homo Sapiens
  allele 53: 12-909-36 : polymorphic base A or G
  misc_binding 33..52: 12-909-36.mis1, potential
  misc_binding 54..73: 12-909-36.mis2, potential complement
  primer_bind 18..38: upstream amplification primer
  primer_bind 505..525: downstream amplification primer, complement
  misc_binding 41..65: 12-909-36 potential probe
  misc_feature 480,526,538..539,545,554..556,573: n=a, g, c or t
taacttgtgttttgactccaggaaaagtaaaatgttagtttgagctcgagaargaatctggatactggtaactttacccagaccttgggaatcttccccctcagtacatttaattaatgaagtgttacaatgaattctcaaaagatctaagagatttgttttcacttcattcgctgtgatcatgggcctaatcagagtcactgcactggcaaccactgctggagtggcattataccaatctattcaaacagctcattttgtcaatgattagcaagtcaattccacccaaatgtggaattctcaacaagacattgatcaaaaattagctaatcaaattaatgatttaagacagtctgttatttggcttggaaatcagctgatgagtctcgaacatcacatgcaaatgcagtgtgatttgaatacttctgatttctgtatcacaccatattcctacaatgagactgatcattcatggaaaantggtcaaaggacaccttctgggtagggaagataatttattcttggnacataactaaannttaaangaaacaaannntttctgaagcctctcangctcatttacccattgtgtctggagctgaggcgttagatcaggtggcagaaagtatttctggactaaaccccacgacttggattaagtctactgggggctccatggtagtaaattttggaataatatttctctgtttaatcgacttgtttttagtgtgctggaccagtcaaagattcccgtgtcaaaacctagagaacaaacaagactttgcaccatggcacatttatataaaaagaaagggagggatgttgtgggaagtcagggaccctgaatggagggactggctggagctgtggcagaggaacataaattgtgaagatttcattttaatatggacctttgtcagttcccaaataatacttttctaatttcttatgcctgtcttactttaatctcttaatcctgttatcttcataacctgaggatg

SEQ ID NO: 395 - DNA, 1001 bp, Homo Sapiens
  allele 193: 12-909-176 : polymorphic base C or T
  misc_binding 173..192: 12-909-176.mis1, potential
  misc_binding 194..213: 12-909-176.mis2, potential complement
  primer_bind 18..38: upstream amplification primer
  primer_bind 505..525: downstream amplification primer, complement
  misc_binding 181..205: 12-909-176 potential probe
  misc_feature 480,526,538..539,545,554..556,573: n=a, g, c or t
taacttgtgttttgactccaggaaaagtaaaatgttagtttgagctcgagaaggaatctggatactggtaactttacccagaccttgggaatcttccccctcagtacatttaattaatgaagtgttacaatgaattctcaaaagatctaagagatttgttttcacttcattcgctgtgatcatgggcctaatyagagtcactgcactggcaaccactgctggagtggcattataccaatctattcaaacagctcattttgtcaatgattagcaagtcaattccacccaaatgtggaattctcaacaagacattgatcaaaaattagctaatcaaattaatgatttaagacagtctgttatttggcttggaaatcagctgatgagtctcgaacatcacatgcaaatgcagtgtgatttgaatacttctgatttctgtatcacaccatattcctacaatgagactgatcattcatggaaaantggtcaaaggacaccttctgggtagggaagataatttattcttggnacataactaaannttaaangaaacaaannntttctgaagcctctcangctcatttacccattgtgtctggagctgaggcgttagatcaggtggcagaaagtatttctggactaaaccccacgacttggattaagtctactgggggctccatggtagtaaattttggaataatatttctctgtttaatcgacttgtttttagtgtgctggaccagtcaaagattcccgtgtcaaaacctagagaacaaacaagactttgcaccatggcacatttatataaaaagaaagggagggatgttgtgggaagtcagggaccctgaatggagggactggctggagctgtggcagaggaacataaattgtgaagatttcattttaatatggacctttgtcagttcccaaataatacttttctaatttcttatgcctgtcttactttaatctcttaatcctgttatcttcataacctgaggatg

SEQ ID NO: 396 - DNA, 1001 bp, Homo Sapiens
  allele 501: 12-909-484 : polymorphic base G or T
  misc_binding 481..500: 12-909-484.mis1, potential
  misc_binding 502..521: 12-909-484.mis2, potential complement
  primer_bind 18..38: upstream amplification primer
  primer_bind 505..525: downstream amplification primer, complement
  misc_binding 489..513: 12-909-484 potential probe
  misc_feature 480,526,538..539,545,554..556,573: n=a, g, c or t
taacttgtgttttgactccaggaaaagtaaaatgttagtttgagctcgagaaggaatctggatactggtaactttacccagaccttgggaatcttccccctcagtacatttaattaatgaagtgttacaatgaattctcaaaagatctaagagatttgttttcacttcattcgctgtgatcatgggcctaatcagagtcactgcactggcaaccactgctggagtggcattataccaatctattcaaacagctcattttgtcaatgattagcaagtcaattccacccaaatgtggaattctcaacaagacattgatcaaaaattagctaatcaaattaatgatttaagacagtctgttatttggcttggaaatcagctgatgagtctcgaacatcacatgcaaatgcagtgtgatttgaatacttctgatttctgtatcacaccatattcctacaatgagactgatcattcatggaaaantggtcaaaggacaccttctgkgtagggaagataatttattcttggnacataactaaannttaaangaaacaaannntttctgaagcctctcangctcatttacccattgtgtctggagctgaggcgttagatcaggtggcagaaagtatttctggactaaaccccacgacttggattaagtctactgggggctccatggtagtaaattttggaataatatttctctgtttaatcgacttgtttttagtgtgctggaccagtcaaagattcccgtgtcaaaacctagagaacaaacaagactttgcaccatggcacatttatataaaaagaaagggagggatgttgtgggaagtcagggaccctgaatggagggactggctggagctgtggcagaggaacataaattgtgaagatttcattttaatatggacctttgtcagttcccaaataatacttttctaatttcttatgcctgtcttactttaatctcttaatcctgttatcttcataacctgaggatg

SEQ ID NO: 397 - DNA, 1001 bp, Homo Sapiens
  allele 347: 12-910-76 : polymorphic base A or G
  misc_binding 327..346: 12-910-76.mis1, potential
  misc_binding 348..366: 12-910-76.mis2, complement
  primer_bind 272..292: upstream amplification primer
  primer_bind 704..724: downstream amplification primer, complement
  misc_binding 335..359: 12-910-76 potential probe
  misc_feature 17,38,54,57,59,62,69,76,87,95,106,109,115,118,122,128,857,876,888: n=a, g, c or t
aataattatacagaacntttaagtgagaaatgtccagnttgtttaatatttggnagncntcnaattctnaaaacanaatggtttgcnaactcatnaaactatttcnacnatatcnagngtcnatttgntgacattttgtgatgtcaacaaaatgataaaattttagaaacccaacatcaattccctcacaaaagtacaaccagtagctatccaaatacaaaaatgccactctgaattcaccagatctcaaggcagaaggagaaaacccgaagactcacagacatgagaaaacttatgattggtaagatgattaatttttttggactgtaccaccccgcttccacaarccaaaatgacaccactgtgagggaacttcctttcacctgcagttattgaaatgggaggagggaatttcaagtggacatttaatttcttcatggatctgtaaatttgaggggaaagcccacatttgtcccaccccacagacggtattaagagtgttcagagggctgaaccacctggggtaaattggggacaggagatggagtagtaatcacagtgatcaccacacagatcttggcatctgctttgtgttcctagatacggggatgccacacagaggagtctcaccagaaccatagcactgcagggggcaaaatcttaaggaaggcctgaatctttgacaaaattttacaattcccaggtagtcatgtggagattttccatgactgggaaacaagtataagacttgaaattaagttccaaggcttgtttaaatgtctcccagatctagaaatcactgcaagtctgggtttaagtaccagtgcagcatttaagttcagatgctcacaataagntctcccaagactggaaaancaacattaaagnaaatactgagttttggtgcagtattaaattctggtggcaaatattcagtccttgcctaaacaaaaagcaactggtggcaaggaattagattccaatattaagtagtaaaggtt

SEQ ID NO: 398 - DNA, 1001 bp, Homo Sapiens
  allele 503: 12-910-295 : polymorphic base C or T
  misc_binding 483..502: 12-910-295.mis1, potential
  misc_binding 504..523: 12-910-295.mis2, potential complement
  primer_bind 209..229: upstream amplification primer
  primer_bind 641..661: downstream amplification primer, complement
  misc_binding 491..515: 12-910-295 potential probe
  misc_feature 6,13,24,32,43,46,52,55,59,65,794,813,825: n=a, g, c or t
attctnaaaacanaatggtttgcnaactcatnaaactatttcnacnatatcnagngtcnatttgntgacattttgtgatgtcaacaaaatgataaaattttagaaacccaacatcaattccctcacaaaagtacaaccagtagctatccaaatacaaaaatgccactctgaattcaccagatctcaaggcagaaggagaaaacccgaagactcacagacatgagaaaacttatgattggtaagatgattaatttttttggactgtaccaccccgcttccacaagccaaaatgacaccactgtgagggaacttcctttcacctgcagttattgaaatgggaggagggaatttcaagtggacatttaatttcttcatggatctgtaaatttgaggggaaagcccacatttgtcccaccccacagacggtattaagagtgttcagagggctgaaccacctggggtaaattggggacaggagatggagtagtaatcacagtgatcaycacacagatcttggcatctgctttgtgttcctagatacggggatgccacacagaggagtctcaccagaaccatagcactgcagggggcaaaatcttaaggaaggcctgaatctttgacaaaattttacaattcccaggtagtcatgtggagattttccatgactgggaaacaagtataagacttgaaattaagttccaaggcttgtttaaatgtctcccagatctagaaatcactgcaagtctgggtttaagtaccagtgcagcatttaagttcagatgctcacaataagntctcccaagactggaaaancaacattaaagnaaatactgagttttggtgcagtattaaattctggtggcaaatattcagtccttgcctaaacaaaaagcaactggtggcaaggaattagattccaatattaagtagtaaaggttgaacaacacaagaatacacctataaaagttagaacatgtggatatctctttaagtatggaaac

SEQ ID NO: 399 - DNA, 740 bp, Homo Sapiens
  allele 240: 12-911-22 : polymorphic base G or C
  misc_binding 221..239: 12-911-22.mis1
  misc_binding 241..260: 12-911-22.mis2, potential complement
  primer_bind 219..237: upstream amplification primer
  primer_bind 653..673: downstream amplification primer, complement
  misc_binding 228..252: 12-911-22 potential probe
  misc_feature 354,703,732,739: n=a, g, c or t
atattttccactgtaatattttatcttagctatatagcctaaaatttaaacaattaatctcgggggggagtgtcgcattcttttgttgtattttcctaggcgatttgatccttttctaatacattgctgacacaagatcactaacaattctaaaatgtcctattcatgatatcactatttttatgatgtcacattttttaaaccttagttgatatgtttattcacaatatgctggtcctstgtagtgcataaatatgaactgacatcaatagatgtaaagaagtcaaaagcataaaattcacaggaggcaatagactatacaagtcatggaagtgttctatgatattagtttgntattaaaaacataacaatgttccctttttgataaaaataagccattttacatagccaacagtactgggcttagaccatgaattggtaatgataataatgatagtgcattactctggaaaaggtttagtatatttctctagaactcatctagatattatggcctacatttctgcctttagtccaatattttttgtgtcctcaatgagaaagagatagttatcatcaatgtgttcaaacaaaagggtaagtgatcctttcttagggagagaatatgtcaacaaggtgatcaagttgaacagattattttaggagaggtaacgacaggaaacattttattaaaaatactaanttttaaaaaactttgatcgtttacttgancaaagant

SEQ ID NO: 400 - DNA, 1001 bp, Homo Sapiens
  allele 501: 12-912-65 : polymorphic base C or T
  misc_binding 481..500: 12-912-65.mis1, potential
  misc_binding 502..521: 12-912-65.mis2, potential complement
  primer_bind 437..457: upstream amplification primer
  primer_bind 908..928: downstream amplification primer, complement
  misc_binding 489..513: 12-912-65 potential probe
  misc_feature 24,47,131,137,440: n=a, g, c or t
acaacaggaagctgcacccttctnctgcattcagacagaagtgaganctgctgggccggaagctctagcaaggatgatagcaatacaagttgattcttaattaattaaagcacattgagaagctgatccanaaaagncaaacactattaaatctctcagactttaaaaatacagtcatattccaggagttaaggggtccagctcaccaacatggcacatgtatacatacgtaacaaacctgtacgttgtgcacatgtaccctagaacttaaagtataataaaaaatatatatatacatagtcatattcatttttcacaacatagcatattgtgacaggtctttcttgatttactaagtttacttattatcctgtgaagtatattttcatacctgaattttacctagcttcagccttccattaacgttgcattcattcttnaacatttgtaaaccaccatattttctagaaattggtgactatattctaaaatcattgtagycacgaaatcatatgaatacctgcttggcctctccggatagggtcaagtttctcacataagcaaaatttacttatttggcatatacaatgtgaacataatcttaaaacctgactttggcttttggtgttattaataaggttcttaatccaatttttgttttttttttacagaagtgatacagctatactgtaatcctagcattcctgagttttgtatatagcttggaaataatatttattgtcaaatatttttaaatacttcactttcttctaatatatttattaaccttagcatctttttttgcattttttccctgtgaagtgtcattcactctatcaattactatcagaaaaatctgttatcatcttgcctatttatgcaaagcaaatgattctccaactgttgactctaatccttcctctcaaataggttctgctaaataaatgaccctgagtctctgagacatttgttgtatcaaagcacaacaacattaacagtaa

SEQ ID NO: 401 - DNA, 1001 bp, Homo Sapiens
  allele 384: 12-914-106 : polymorphic base C or T
  misc_binding 365..383: 12-914-106.mis1
  misc_binding 385..404: 12-914-106.mis2, potential complement
  primer_bind 279..298: upstream amplification primer
  primer_bind 773..793: downstream amplification primer, complement
  misc_binding 372..396: 12-914-106 potential probe
  misc_feature 536,990: n=a, g, c or t
aactcctattatatggaggtagttttcttaataatgtttgatactttccatatgcctacttcactaattttaattatttctctttttttgctcttctgattgggtaattacatatgttttatctttaggattgctgattccttactctgtttgaccaagtctgctgttgaagttttctactgagtttttcaattcacttcacatattttttattaattggatttctttttatttttaaaacatttccacttctttgcaaaatttatcatcattttcctggattattctctaaagtgtgttttttttcaactctctattcatatgtgctgtgatttctgaacttttaaaataggtgtgcactgaatttcttgtcaaaaattttayggagcatctgaaccttaattctgcactgtaacttaaaactagacttgcagtgatttctaggtctgtgagatacttaagcaataactggagcttaatctcaaatgttatacttgtttgcaggtcatagaaaagctccgtatgagtaactgggnattataaaaatacctgccaaagattcaggccttcctttggattttggcccctgcagtgttatggaactggtcagactcctcagcgtggcattcctgctaataggaacaccaagcagttgctgagatgtgtgtgcctgtcactgtgattagtacttccactcttgtttccaattcaccccaggtcattcaactctatagccactcctaatgcctctcctgaggtaggacaaaagtgggcttcccaaaccaaaaagattcacagatccatgaagaaactgaacattcacttcaaatttcctcctctgatcttggcaactgcaggtaaaataaagttctgtcacagtggtgtcttcttggtgtgtggaaggggtgccataatccaaaaaattattcattttacagatcatgagttttcccatgtctatgagtcttgggattttcttcttctcttttnagctctggtga

SEQ ID NO: 402 - DNA, 1001 bp, Homo Sapiens
  allele 503: 12-914-252 : polymorphic base A or T
  misc_binding 483..502: 12-914-252.mis1, potential
  misc_binding 504..523: 12-914-252.mis2, potential complement
  primer_bind 252..271: upstream amplification primer
  primer_bind 746..766: downstream amplification primer, complement
  misc_binding 491..515: 12-914-252 potential probe
  misc_feature 509,963: n=a, g, c or t
ttaataatgtttgatactttccatatgcctacttcactaattttaattatttctctttttttgctcttctgattgggtaattacatatgttttatctttaggattgctgattccttactctgtttgaccaagtctgctgttgaagttttctactgagtttttcaattcacttcacatattttttattaattggatttctttttatttttaaaacatttccacttctttgcaaaatttatcatcattttcctggattattctctaaagtgtgttttttttcaactctctattcatatgtgctgtgatttctgaacttttaaaataggtgtgcactgaatttcttgtcaaaaattttatggagcatctgaaccttaattctgcactgtaacttaaaactagacttgcagtgatttctaggtctgtgagatacttaagcaataactggagcttaatctcaaatgttatacttgtttgcaggtcatagaaaagctccgtatgagtawctgggnattataaaaatacctgccaaagattcaggccttcctttggattttggcccctgcagtgttatggaactggtcagactcctcagcgtggcattcctgctaataggaacaccaagcagttgctgagatgtgtgtgcctgtcactgtgattagtacttccactcttgtttccaattcaccccaggtcattcaactctatagccactcctaatgcctctcctgaggtaggacaaaagtgggcttcccaaaccaaaaagattcacagatccatgaagaaactgaacattcacttcaaatttcctcctctgatcttggcaactgcaggtaaaataaagttctgtcacagtggtgtcttcttggtgtgtggaaggggtgccataatccaaaaaattattcattttacagatcatgagttttcccatgtctatgagtcttgggattttcttcttctcttttnagctctggtgaattcagtgtggctttttgtatttacat

SEQ ID NO: 403 - DNA, 1001 bp, Homo Sapiens
  allele 503: 10-448-266 : polymorphic base A or C
  misc_binding 483..502: 10-448-266.mis1, potential
  misc_binding 504..523: 10-448-266.mis2, potential complement
  primer_bind 238..257: upstream amplification primer
  primer_bind 660..679: downstream amplification primer, complement
  misc_binding 491..515: 10-448-266 potential probe
  misc_feature 772,907,915: n=a, g, c or t
gaattatcacattgcacaaggatggctctgaaatggactacagttctgctgatacaactcagtttttactttagctctgggagttgtggaaaggtgctggtatgggccgcagaatacagcctttggatgaatatgaagacaatcctgaaagaacttgttcagagaggtcatgaggtgactgtactggcatcttcagcttccattctttttgatcccaacgactcatccactcttaaacttgaagtttatcctacatctttaactaaaactgaatttgagaatatcatcatgcaattggttaagagattgtcagaaattcaaaaagatacattttggttacctttttcacaagaacaagaaatcctgtgggcaattaatgacataattagaaacttctgtaaagatgtagtttcaaataagaaacttatgaaaaaactacaagagtcaagatttgacatcgtttttgcagatgcttatttaccctgtggtgagctgctggctgmgctatttaacataccctttgtgtacagtcacagcttcagtcctggctactcatttgaaaggcacagtggaggatttattttccctccttcctacgtacctgttgttatgtcaaaattaagtgatcaaatgactttcatggagagggtaaaaaatatgctctatgtgctttattttgacttttggttccaaatatttaatatgaagaagtgggatcagttttacagtgaagttttaggtaagatttttttcagttagtaacatgaagctnctaacttatttgtgtctttgaagcacaacttgcataaagccataaagtcagggaagtggagtttttgataaatgaatttatgaaatgaaaatacaagatgatctaccaatctcacaaatattatagaaaagcttnaaattatnggggtcagtgaaaacgctgtgaccatcactcatacagaacaccccaggaaatcataaacctatatattagtacacctaagacttta

SEQ ID NO: 404 - DNA, 1001 bp, Homo Sapiens
  allele 503: 10-453-330 : polymorphic base C or T
  misc_binding 483..502: 10-453-330.mis1, potential
  misc_binding 504..523: 10-453-330.mis2, potential complement
  primer_bind 172..189: upstream amplification primer
  primer_bind 578..597: downstream amplification primer, complement
  misc_binding 491..515: 10-453-330 potential probe
  misc_feature 19,31,101,212,337,520,661: n=a, g, c or t
cattagtccaactggaaantcttgtattaangttttgcagtctgaagtcacaccaccatatagccttcagttacatctccaacacaagtacctgttttttncctctgaaatctgaaaagtaatagcaaattagttcagtgtgttatctagaaaacactgtcactttcagagcctttcattgtgcatctcattttattcctatgaataatttntgctaaaattcatccaatcctaggtcatccaaaaaccagagcttttataactcatggtggagccaatggcatctatgaggcaatctaccatgggatccctatggtgggcattccattgttttttngatcaacctgataatattgctcacatgaaggccaagggagcagctgttagagtggacttcaacacaatgtcgagtacagacctgctgaatgcactgaagacagtaattaatgatccttcgtgagtagaacaatatttttcactagatggtattaatagatagcttytcttgtcagtagtgagncatgagtttcatcctttttataagagagtgattttgaaagaatttaaatgatttaaccaatccgaaatctgcttttactttttatctgttatttaaaaattgtatttgaaccccatacatctaatgagtaaccagttagtngaaacagttttctaaataaaaataattttaaaatgatatagataatataaaaaaatacatttcttaaaaatttgacataatgaatccatagtagaaaggaagaataatcttgaaataatataataaaatgttttaattaaatatctaaaatgtctcagaatataactattttcttgcagaaaaattaatttttattattatctttattgtaacagacttgaaaatgagatttaattttgatagcataaaacccacctatttatggcaaaaattccaaatatttttactatgtttacagagtcatgaagtcatcaccagtgtataagtttggaacattttt

SEQ ID NO: 405 - DNA, 1001 bp, Homo Sapiens
  allele 503: 10-455-367 : polymorphic base C or T
  misc_binding 483..502: 10-455-367.mis1, potential
  misc_binding 504..523: 10-455-367.mis2, potential complement
  primer_bind 135..152: upstream amplification primer
  primer_bind 545..564: downstream amplification primer, complement
  misc_binding 491..515: 10-455-367 potential probe
  misc_feature 161,248: n=a, g, c or t
tttaaaagccaaactttgtatgatgactcaaattaaaatacataaattctatatcaattctttgacatttactttgaattatttgacactttaaaagcctttcatagacttgatatctacaggcaaattaacttactttcagtgtcggtatctttattttntatccttcagatataaagagaatattatgaaattatcaagaattcaacatgatcaaccagtgaagcccctggatcgagcagtcttcntggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggaaaacctgatagataggaatacttcagytgattccagcaataaatattgtgatgcaagatttctttcttcctgtgacaaaaaaaaatcctttcgaagtctaccttgtcaagtaaaaatttgtttttcagagatttaccacccagttaatggttagaaatattctgtggcaatgaagaaaacactaggggaaataaaaaataatataaagccatatgagcttgtattgaaatttgttgcacttatattgaaatgtgatcatggctcacttcagcctcaacttactaagctcaagaggttctctcacctcagccccccaagtagctgggaccataggtgcatgtcaccatgtccaactaattttttattttttgtagtgatgagatctcattgtgttctccatgctgatttcaaactcctgggctcaaacaatcctcccattttagcatcccaaagggatgagattacaggtatgtaccaccataactttacaaaatgagatttttatataagaatgattcaaatgtt

SEQ ID NO: 406 - DNA, 1001 bp, Homo Sapiens
  allele 503: 12-5-158 : polymorphic base C or T
  misc_binding 484..502: 12-5-158.mis1
  misc_binding 504..523: 12-5-158.mis2, potential complement
  primer_bind 346..366: upstream amplification primer
  primer_bind 801..821: downstream amplification primer, complement
  misc_binding 491..515: 12-5-158 potential probe
  misc_feature 314,336,793: n=a, g, c or t
caaaggatgaaggtcctctggaccagaagcacccaaccagattattcagcaacaggactgagggtgcctggggcaagtgccagctcatgccatcaccctcacagagccccgggtaagtttaaccattgagggccaggaagtggacttcctcctgggcactggcgcggccttctcaattttaatcccctgacccagatgactgttctcaaagtccgttactatctgaggaatcttaggacagcctgtaaccaggtatttctctcgcctcctcagctgcaattgagagactttgctctttcacatgccttttctgnttatgtctgaaagtcccacacnctttattagggagagacatatttgccaaagctggggccattatctacatgaatatggggaacaagtgacccatttgttgtcccctacttgaagaagaaatcaactttgagctctgggccttagaaggacaatttggaagggcaaagaatatccatccagtccacatyaagctaaaagacaccaccacttttccttatcaaaggaaatatcacttaaggcctgaagttctcaaaggattacaggatattgttagaaatttaaaagctcaaggtttagtaaaaaaatgtagcagtctttgaaacaccccaatcctaggaatacaaaaaccaaatagtggagactagggcaagacctcaggtttcacctatctaccttcaggaaatttttttcatctgtgataacacagcctatcgatgccaaaatggcactccaaaagaactatgctatgtctcatttnctagcacctcccatgtccatatatactgaacaagagttacaaagtctccttataccccaatctcgccacacccgagcccttattgtcccttttacagtaggagcaggaatactaggcaggcttgggactggaattggaggcataacctcctccacccaattctattataaattatcatgagaattaaatgatgacatggaatgagttg

SEQ ID NO: 407 - DNA, 1001 bp, Homo Sapiens
  allele 499: 12-9-367 : polymorphic base G or A
  misc_binding 500..518: 12-9-367.mis1, complement
  misc_binding 479..498: 12-9-367.mis2, potential
  primer_bind 847..865: upstream amplification primer, complement
  primer_bind 386..406: downstream amplification primer
  misc_binding 487..511: 12-9-367 potential probe
  misc_feature 231,891: n=a, g, c or t
gggagcaacaagcagctaggggaaccccaccctcccagggaagcattgagtaattgtgcaaccacaggaaaccatacttctcccaagaatctttgcaaccctcaagtcaagaagtctacctgtgaactcacatcaacagggccttcattctgacagccagaaaaaggtggagtctcagcagagcatctactcaggcatgcgaggtgaccctggaaccttagctatgtgggnctttctggcaaaagtaactgcagctttggcaaattaggagattagaaccacatacatatccctaggaaaaaggctgaatccaagggactgagaagatacagcctgcaggccccactttcacagcacctcacaggtgagcacccactggcttaaaattccagcaagccaccaatagcggcattgcacctccataagaaggagctctcagtgggagtggcaggctgccacctttgctggcctttattcttagtttttctctcccatcacrgaaattccatcctatgagtggactggggcaatggctatttggtactcagtattctttgtgccgttcttgagttgaatctctgagttatgactgtggctgaatgaaagatgtgagacccttcttagccacacttgcctagaattaagcttctggagcatatgcctgagtctatatatataaaaaaatcagagagacaccttttctcaactgcataccctgacactcaactgggagctttgaagagtgagagccctgtggtagcatcagcacctccctggaagagagggagtttctgtcactgaactaggagggggggcaaatgagcatgttgtggcttaaatgccaaagacacttgctgttttcactacaaattactggattttcttcagtgnaatgttactttattatatgcctttaggattattgccagggacaccaaatggttgttttaaaaaacaattttcaccagttattcctgtttcccttgaaatttcctccatgg

SEQ ID NO: 408 - DNA, 1001 bp, Homo Sapiens
  allele 501: 12-10-303 : polymorphic base T or C
  misc_binding 502..521: 12-10-303.mis1, potential complement
  misc_binding 482..500: 12-10-303.mis2
  primer_bind 787..807: upstream amplification primer, complement
  primer_bind 335..355: downstream amplification primer
  misc_binding 489..513: 12-10-303 potential probe
  misc_feature 67,85,89,608,657,722..723,752,854,885: n=a, g, c or t
agttgccccaccttttcagaccaaacccatgtatcatttacatgtattgattgatgtggaacatctnctctaaattgtataaaanccanggttgtagcctgaggacattgggcacatgttctaaacagctgaaggctgtgttatgggccattagtcactcatatttggctcagaataaatctctttgaatattttacagagtttgactcatttcctcacaataatttgacacttgaacatgtgggaactcccagaaaacccaggacccccaaaatgtttcctgaacttgaaactaaagtaccagaaggggcccattgaaggcctttcaaactttaagctcctctgatggaactggtcagtcctcttgagccctggatctccctttggttgacagacatcaatttttcctgaacttatttttttcctaggaagttgttgtttaggattctaattctagttctggggtgcattctgaagagtcttctccattgccttttatcyaaaagataaactcaattggcttgtctgcacatttgcatgaagatagaactgtcattttatagataaatgagggactgagctcctcagctttgaagagaaagaacatntttgctcctcccagaaaatgagccctggatgaccagaggctaagtgggnaacatctagatgtttgactcccattcccgttatgtgcagtgcccctacagaagatgccccaacanntaattagtttcttctgtgtttaaatgttntttaactgctgagatatttaaaagcttgtagaatcaatctctaagaagcagacacatcatattattgcaatttttgtagttcaatttactatggaatttttnatgactctccatcaagtataccttcatgttncatatattttcctaagtatatatgtacatatcactttatgtagaaagtcttcctcaaattaaactagtgaaaatattacttgttcactcatggatagacatagatttatgtatctg

SEQ ID NO: 409 - DNA, 1001 bp, Homo Sapiens
  allele 501: 12-14-264 : polymorphic base C or T
  misc_binding 482..500: 12-14-264.mis1
  misc_binding 502..521: 12-14-264.mis2, potential complement
  primer_bind 237..257: upstream amplification primer
  primer_bind 680..700: downstream amplification primer, complement
  misc_binding 489..513: 12-14-264 potential probe
  misc_feature 307,577,897: n=a, g, c or t
tgaaatgttaacttcatacaatatagtaaatggtcacatatcactgttcctgttatctttactgggggctggaaaaaatgggaagaactgggcctccagacttttcttggatgcctcattgtcaaatgttaataaagagcacagtgggactttgtgttttctatttttgatggtgcccaaatggtctgtactttcagatgtattgcacatttacattctcaataaagtatattaatgataaaagacttgtaacatggagaataactcaaggagaaagtcttttattagttttctgttgctgcattancaaactacctcatttcttaatatcttaaaaaaaaaactgtttaactcatggtttcatggttcttctcacaattttgatctaggctagtatagctgatctcagcaggtcctgcccactttcaggtgcatatgaaactataggaacctggctgatcctaaaagccgttagttgcatgctttgcatttgcctgagcygtgtctttgtaggtatatgtcatgtgggtgtctctcatcatcacaatgtgtaactgtagtacaagtgctaataggnaaagtctcatacactaaagtaaacaacattaagcatactatatttatgtaataaatgtatgattgtgcaccatatgtcctactggaaacaatttttaaaattctcaaactactgcctttcaatttaagactctactgggctacataatttaaagaaatttagaaatttctctcatgaaaaaatatacatttcgtgaaaaatatccatacacgttaaataaatatgaagagtgttttaataggccccagatttttaggacagtccagattacaccttttctgcttgagtcactttaatgatgcctcaaaaattggataatntttaacattccacatgaaactttgtaataaattatatatatcgcacatattttacatacatataactttatataaaaactttaaaaatagtaaatatacagata

SEQ ID NO: 410 - DNA, 1001 bp, Homo Sapiens
  allele 499: 12-17-86 : polymorphic base T or A
  misc_binding 500..518: 12-17-86.mis1, complement
  misc_binding 479..498: 12-17-86.mis2, potential
  primer_bind 565..584: upstream amplification primer, complement
  primer_bind 121..140: downstream amplification primer
  misc_binding 487..511: 12-17-86 potential probe
  misc_feature 44,197,388..389,398,407,627,852,856,941: n=a, g, c or t
gaagttgaggtgtacaggtgaggcaacttgccaaaccccacatnaattctctagaggttttgcagggacttgaatccaggctaactggatccagagtgcaggagctcttaaccaccatgctacgctgactcccctttctgagttagttattttcaaaatgtcacatttgtagtttccattttcttgtctctatattnaagtgtatattattatgaatgtataattaaatttttagaaatatccttgtagctatttatcacttcctaacaaactaccctcaatcatggggactttgaaaaacaattagcattttattacaatttccatagcatgagtgttgggtaggttcagcaagatggttcatacacagtatttctcaggtcattannctttaatangggtggctnggggatgtaatcatctgaaggtcattcattcacgtacttggtgatggatgtcaaaagactcaaattcctgtgggactgaataatcatgactwcttagtctcttctttgcatcattccccgagttgtcatttatcatcaggactttgggtgtaacactgggctccaaagtatatagagggagaaaaagggaaagagggaggagagagagagagagagaaangaggtataagtaaaagacatagacagacagacaaacggagacagactgccttttctaacacagtcttcaaaactatgctgtcacttccagtatactttctttgctgagaaagccacgagtcttgccaaaattcaaggggagggaccacggtttgataagaatgtcaaagtgtttgcagtgatgtctcaaaattccacaaatataacctattgagttagtcaacangaangcctctaagcaactatgaaattcattacatatggacattaaaaacacaataaaatcctaaaaagtgtgaatttatattttttacnaactactgaaacattaagcattttaaaatatttactcatagatttttatatatgaaatag

SEQ ID NO: 411 - DNA, 1001 bp, Homo Sapiens
  allele 501: 12-19-163 : polymorphic base A or G
  misc_binding 481..500: 12-19-163.mis1, potential
  misc_binding 502..520: 12-19-163.mis2, complement
  primer_bind 339..357: upstream amplification primer
  primer_bind 781..801: downstream amplification primer, complement
  misc_binding 489..513: 12-19-163 potential probe
  misc_feature 612,814,950: n=a, g, c or t
accttgaaaagaggttagatgaatttctaactagaataaccagtgtttgacttcttcctggtttaagcttgggaaagtgtacgtgtccaggaatttatcaatttgttctaaattttctagtttatttgcgtacaggtgtttatagtattctctgatggcagtttgtatttctgtgggatcagtggtgatatcccccatatcattttttattgcgtctatttgattctgccaattcatagcacatacagcattctggagaactttggcccagccatgaaaagtactgttacctagctgacactgtaactataacttctaaaggccatttcactatagtacaaaggcagttgcttcaggagaatgaggaacatggtaaaaccagtaaatttcatgagcatgagctcattgttgcacttctttgtcagtaaagccagttccttagtcagaaacaatactgtgtggaagaccatgatagagaattaggcatccagtaaatttatrgatggtagttttgacagatgtatatgttcagagaagataaatccatattcaaaataagtatgtattccagtaagaaaaaaatgcagctccttctatgatggaggtggtctnaaggtaatcaatctgccactgggaagctggttgattatcttggagaatgatgccatatcaggggcttagcatggctctctgttcctgcatattgggcacacagtggtggctttagccaggttgaacttagtgagtgaaagattatgttgcttaacccatgcataacttccatcaatgccatcatagccactttgctcatgangcccattgggtgataacaggggtagctgaggaaagagtctgaccccagatctacaggaggggtcatcccatccactttattattaaaattttcttctagtgatgtcattctttgaagaacattcacatgactcacnaaatgtcttcatatattttgccccctcaaagaggtttatccagatagtttt

SEQ ID NO: 412 - DNA, 1001 bp, Homo Sapiens
  allele 503: 10-457-284 : polymorphic base G or T
  misc_binding 483..502: 10-457-284.mis1, potential
  misc_binding 504..523: 10-457-284.mis2, potential complement
  primer_bind 220..238: upstream amplification primer
  primer_bind 621..639: downstream amplification primer, complement
  misc_binding 491..515: 10-457-284 potential probe
  misc_feature 715: n=a, g, c or t
ggtcataaaaattattgcttgactagagtaattgtaaacataaaagaacaccaaacacactaaaataaatatgaggtcatcaatcttttgttggtctccttggcatgcacctattcagactgttagtattatgtatttacttcaaattttagcagttatattttaacttgattgatttttcctcagatataagtatgagaaatgacagaaagaaacaacaactggaaaagaagcattgcataagaccaggatgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaatkatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaantccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggtaagtcatgtgtctaactggtgctt

SEQ ID NO: 413 - DNA, 1001 bp, Homo Sapiens
  allele 503: 10-460-221 : polymorphic base C or T
  misc_binding 483..502: 10-460-221.mis1, potential
  misc_binding 504..523: 10-460-221.mis2, potential complement
  primer_bind 283..301: upstream amplification primer
  primer_bind 686..704: downstream amplification primer, complement
  misc_binding 491..515: 10-460-221 potential probe
  misc_feature 128,707,966: n=a, g, c or t
atggggattataattcaagatgagaggagatttgggtggggacagtcaaaccatattagtgacttattttaataattatttatgattgtgaatatactgatgttacattaaagatgtgatttcttctnacagatctctgaatacatttgccttccttatatatacatatgagcaacatatgcaataaataaaatctaaattatgactatatataaatgtatttatatatattttatcaatgcacagacattttatatatgtttgggtatgttattccaagtcctttcaggaaaatacctgcatattcaaataacaattctcgtgttagctaccttttgttttgttttgtttttttccatcaggaagacccactacattatttgagacaatggggaaagctgaaatgtggctcattcgaacctattgggattttgaatttcctcgcccattcttaccaaatgttgattttgttggaggacttcactgtaaaccagccaaacccytgcctaaggtaaatgtattcttgtttcatttgtttgcttgacattttcagaaggaatggctggatatgtttctttcagagtgtttaactcagagtgaggggaatatgggaggtcaaaaacaaggacttgccattagaaaatcatatatttctgtagtatcacaagtatgtgaatgttattatcattaaagaccaaagaggtttnactagggagattttgaaaacagggttggttaaagtaaggccttcattgtgccacccaaaagatagtatgattcatttcttcaaaaaatatttgtagagtgattaatacaaaccacaggtaagtgctggattttcagagaataaaggtagcacagtttctgctccctcatgccttacattgtactttgaaagatagaataaaaacaagtgaaaaagaaaagtctaaaaagtgttataaggaaagaccacaatgataaagnaaatatgcagaagagatcccaaactcattgacaat

SEQ ID NO: 414 - DNA, 1001 bp, Homo Sapiens
  allele 503: 10-460-232 : polymorphic base A or G
  misc_binding 483..502: 10-460-232.mis1, potential
  misc_binding 504..523: 10-460-232.mis2, potential complement
  primer_bind 272..290: upstream amplification primer
  primer_bind 675..693: downstream amplification primer, complement
  misc_binding 491..515: 10-460-232 potential probe
  misc_feature 117,696,955,992: n=a, g, c or t
aattcaagatgagaggagatttgggtggggacagtcaaaccatattagtgacttattttaataattatttatgattgtgaatatactgatgttacattaaagatgtgatttcttctnacagatctctgaatacatttgccttccttatatatacatatgagcaacatatgcaataaataaaatctaaattatgactatatataaatgtatttatatatattttatcaatgcacagacattttatatatgtttgggtatgttattccaagtcctttcaggaaaatacctgcatattcaaataacaattctcgtgttagctaccttttgttttgttttgtttttttccatcaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggtraatgtattcttgtttcatttgtttgcttgacattttcagaaggaatggctggatatgtttctttcagagtgtttaactcagagtgaggggaatatgggaggtcaaaaacaaggacttgccattagaaaatcatatatttctgtagtatcacaagtatgtgaatgttattatcattaaagaccaaagaggtttnactagggagattttgaaaacagggttggttaaagtaaggccttcattgtgccacccaaaagatagtatgattcatttcttcaaaaaatatttgtagagtgattaatacaaaccacaggtaagtgctggattttcagagaataaaggtagcacagtttctgctccctcatgccttacattgtactttgaaagatagaataaaaacaagtgaaaaagaaaagtctaaaaagtgttataaggaaagaccacaatgataaagnaaatatgcagaagagatcccaaactcattgacaattnaaagtgagt

SEQ ID NO: 415 - DNA, 1001 bp, Homo Sapiens
  allele 503: 10-460-235 : polymorphic base C or T
  misc_binding 483..502: 10-460-235.mis1, potential
  misc_binding 504..523: 10-460-235.mis2, potential complement
  primer_bind 269..287: upstream amplification primer
  primer_bind 672..690: downstream amplification primer, complement
  misc_binding 491..515: 10-460-235 potential probe
  misc_feature 114,693,952,989: n=a, g, c or t
tcaagatgagaggagatttgggtggggacagtcaaaccatattagtgacttattttaataattatttatgattgtgaatatactgatgttacattaaagatgtgatttcttctnacagatctctgaatacatttgccttccttatatatacatatgagcaacatatgcaataaataaaatctaaattatgactatatataaatgtatttatatatattttatcaatgcacagacattttatatatgtttgggtatgttattccaagtcctttcaggaaaatacctgcatattcaaataacaattctcgtgttagctaccttttgttttgttttgtttttttccatcaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggtaaaygtattcttgtttcatttgtttgcttgacattttcagaaggaatggctggatatgtttctttcagagtgtttaactcagagtgaggggaatatgggaggtcaaaaacaaggacttgccattagaaaatcatatatttctgtagtatcacaagtatgtgaatgttattatcattaaagaccaaagaggtttnactagggagattttgaaaacagggttggttaaagtaaggccttcattgtgccacccaaaagatagtatgattcatttcttcaaaaaatatttgtagagtgattaatacaaaccacaggtaagtgctggattttcagagaataaaggtagcacagtttctgctccctcatgccttacattgtactttgaaagatagaataaaaacaagtgaaaaagaaaagtctaaaaagtgttataaggaaagaccacaatgataaagnaaatatgcagaagagatcccaaactcattgacaattnaaagtgagtact

SEQ ID NO: 416 - DNA, 1001 bp, Homo Sapiens
  allele 503: 10-460-236 : polymorphic base A or G
  misc_binding 483..502: 10-460-236.mis1, potential
  misc_binding 504..523: 10-460-236.mis2, potential complement
  primer_bind 268..286: upstream amplification primer
  primer_bind 671..689: downstream amplification primer, complement
  misc_binding 491..515: 10-460-236 potential probe
  misc_feature 113,692,951,988: n=a, g, c or t
caagatgagaggagatttgggtggggacagtcaaaccatattagtgacttattttaataattatttatgattgtgaatatactgatgttacattaaagatgtgatttcttctnacagatctctgaatacatttgccttccttatatatacatatgagcaacatatgcaataaataaaatctaaattatgactatatataaatgtatttatatatattttatcaatgcacagacattttatatatgtttgggtatgttattccaagtcctttcaggaaaatacctgcatattcaaataacaattctcgtgttagctaccttttgttttgttttgtttttttccatcaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggtaaatrtattcttgtttcatttgtttgcttgacattttcagaaggaatggctggatatgtttctttcagagtgtttaactcagagtgaggggaatatgggaggtcaaaaacaaggacttgccattagaaaatcatatatttctgtagtatcacaagtatgtgaatgttattatcattaaagaccaaagaggtttnactagggagattttgaaaacagggttggttaaagtaaggccttcattgtgccacccaaaagatagtatgattcatttcttcaaaaaatatttgtagagtgattaatacaaaccacaggtaagtgctggattttcagagaataaaggtagcacagtttctgctccctcatgccttacattgtactttgaaagatagaataaaaacaagtgaaaaagaaaagtctaaaaagtgttataaggaaagaccacaatgataaagnaaatatgcagaagagatcccaaactcattgacaattnaaagtgagtactc

SEQ ID NO: 417 - DNA, 1001 bp, Homo Sapiens
  allele 503: 10-460-285 : polymorphic base A or T
  misc_binding 483..502: 10-460-285.mis1, potential
  misc_binding 504..523: 10-460-285.mis2, potential complement
  primer_bind 219..237: upstream amplification primer
  primer_bind 622..640: downstream amplification primer, complement
  misc_binding 491..515: 10-460-285 potential probe
  misc_feature 64,643,902,939: n=a, g, c or t
tattttaataattatttatgattgtgaatatactgatgttacattaaagatgtgatttcttctnacagatctctgaatacatttgccttccttatatatacatatgagcaacatatgcaataaataaaatctaaattatgactatatataaatgtatttatatatattttatcaatgcacagacattttatatatgtttgggtatgttattccaagtcctttcaggaaaatacctgcatattcaaataacaattctcgtgttagctaccttttgttttgttttgtttttttccatcaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggtaaatgtattcttgtttcatttgtttgcttgacattttcagaaggaatggctggwtatgtttctttcagagtgtttaactcagagtgaggggaatatgggaggtcaaaaacaaggacttgccattagaaaatcatatatttctgtagtatcacaagtatgtgaatgttattatcattaaagaccaaagaggtttnactagggagattttgaaaacagggttggttaaagtaaggccttcattgtgccacccaaaagatagtatgattcatttcttcaaaaaatatttgtagagtgattaatacaaaccacaggtaagtgctggattttcagagaataaaggtagcacagtttctgctccctcatgccttacattgtactttgaaagatagaataaaaacaagtgaaaaagaaaagtctaaaaagtgttataaggaaagaccacaatgataaagnaaatatgcagaagagatcccaaactcattgacaattnaaagtgagtactcaataatgtgcagagataggtgaaacgatgaggggttgataaacacccaa

SEQ ID NO: 418 - DNA, 1001 bp, Homo Sapiens
  allele 501: 12-605-58 : polymorphic base G or T
  misc_binding 481..500: 12-605-58.mis1, potential
  misc_binding 502..520: 12-605-58.mis2, complement
  primer_bind 444..464: upstream amplification primer
  primer_bind 901..921: downstream amplification primer, complement
  misc_binding 489..513: 12-605-58 potential probe
gttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttatkctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatt

SEQ ID NO: 419 - DNA, 1001 bp, Homo Sapiens
  allele 501: 12-607-207 : polymorphic base G or A
  misc_binding 481..500: 12-607-207.mis1, potential
  misc_binding 502..521: 12-607-207.mis2, potential complement
  primer_bind 689..707: upstream amplification primer, complement
  primer_bind 179..199: downstream amplification primer
  misc_binding 489..513: 12-607-207 potential probe
  misc_feature 531,558: n=a, g, c or t
atgtacatgtatatatgtgttcacttcttccaaaacaaggcacagaattattgagctgccttacagatgtttgtgaaactgaatgtgtttgtagaagacagttaaaaatgataattattctatataaccctattttatataaggatgtctcatgtttctctctttcctcagaagcctgtaactctattcatcccataacactaatatgaaaacataagtcatttagcatgaccaaaaataggataatgattttttaaaatgtaagcatattgcaactaatcataatcagtaacaattaaaagaccacaaaaattaccaaaaattggcaaataataaaatctcaggaattctcaaggccctcttaaaagctacacatcaaggaaacactttatgatcaaagtagtatgggttaacacaaacctatgtgtctttattggtaagaagaccatcatccaagtctcacaataaccactctatgacctatggcatgaatgtattctraaaataaattaaaattttgatgctaagggnaattattggaagagattgcagcaacantttttataaaatgtatctagataaatgaaacatttttaagaaaaattgaatgaatatagtgtcatagtagataatattgctaaatcatgcatacaaacctaaagtaatttacatcaagcttatcctgcaacacatagataaaggactggtatctcttgtatagtgagagctattatatatcaccaaccaaaaagacaaacagaccaatatgaaaatagatgaaggatatgaattgacaattcacagaagtaaaaatggccaatcacatcaaaaagatggctacttgtactagaaagttggacattataatttagtaagtcaataaccttaagtcaatgaatttattttaacttttattttaagctcaggggtacatgtgcaagtttgttacataggtaaatatgtgtcaacacccaggtattaagcctagtacccactaatta

SEQ ID NO: 420 - DNA, 1001 bp, Homo Sapiens
  allele 499: 12-609-119 : polymorphic base T or G
  misc_binding 500..518: 12-609-119.mis1, complement
  misc_binding 479..498: 12-609-119.mis2, potential
  primer_bind 597..615: upstream amplification primer, complement
  primer_bind 114..134: downstream amplification primer
  misc_binding 487..511: 12-609-119 potential probe
  misc_feature 454: n=a, g, c or t
ttttaaaaatacttaccaatatatggtctgaattgacatattttagaatttctttttttatttgtaaacagttttataaagaaatttcccccaatgattaggaccagaaagtatatttgttatgacagaaggggttggtcattattttactgagaaaaagagaatttagaacaaaagggacaacagcaacaaaaagatgagtatacaattttgatatgatatccaggaaacttatgggtctacatttcttttcctctttctctctctcttttttttttttttggtgtgagaatacattgagcgatgtggcattagagaatggatttaagtttaaaaacagggacacatcaggaaacacaagtcagaataattctcattcatttcaaagcaaacacatattcaccaggagcttcatatagtgtgagggagctactctagggggtgagcagatctnccactggagaaagtcctggtgacctctcccactgtggttcaagtkccccctgtgagacacagcaaagtgatgatgagggtcccccacattcagttatacatagcacatcaaattcacagtgtgatttcaggacaaaaggtgtcatagtcatacctaagcaatgacctgagaaataagatcacttaattatgtaactatatagtatataatactgtattataaatggaattctcagaactatttcccagaaattccaaaccacaataccagactgctgaatgtcagtgattcttatacttcagcttttaaggtgtttttggggggtgggggtgtcgggggcagtgaggggtagtggggtaagactaggaaaccctaactttaagtgaaatataaagggttagagagctagaagctaaataaatgtagatataatatcattccaattgtaactaacttttcctcaatgctcatagtcatgtaatggctccaatgactcctaactaaaagaactgaacagaaaaaaataaaataaaataaaactacccca

SEQ ID NO: 421 - DNA, 1001 bp, Homo Sapiens
  allele 499: 12-609-180 : polymorphic base T or G
  misc_binding 479..498: 12-609-180.mis1, potential
  misc_binding 500..519: 12-609-180.mis2, potential complement
  primer_bind 658..676: upstream amplification primer, complement
  primer_bind 175..195: downstream amplification primer
  misc_binding 487..511: 12-609-180 potential probe
  misc_feature 34,53..54,515: n=a, g, c or t
ggtgacagagaaagactccatctggaaaaaaaanaaagatgtcataaagttannttatattttttaaaaatacttaccaatatatggtctgaattgacatattttagaatttctttttttatttgtaaacagttttataaagaaatttcccccaatgattaggaccagaaagtatatttgttatgacagaaggggttggtcattattttactgagaaaaagagaatttagaacaaaagggacaacagcaacaaaaagatgagtatacaattttgatatgatatccaggaaacttatgggtctacatttcttttcctctttctctctctcttttttttttttttggtgtgagaatacattgagcgatgtggcattagagaatggatttaagtttaaaaacagggacacatcaggaaacacaagtcagaataattctcattcatttcaaagcaaacacatattcaccaggagcttcatatagtgtgagggagctactctakggggtgagcagatctnccactggagaaagtcctggtgacctctcccactgtggttcaagtgccccctgtgagacacagcaaagtgatgatgagggtcccccacattcagttatacatagcacatcaaattcacagtgtgatttcaggacaaaaggtgtcatagtcatacctaagcaatgacctgagaaataagatcacttaattatgtaactatatagtatataatactgtattataaatggaattctcagaactatttcccagaaattccaaaccacaataccagactgctgaatgtcagtgattcttatacttcagcttttaaggtgtttttggggggtgggggtgtcgggggcagtgaggggtagtggggtaagactaggaaaccctaactttaagtgaaatataaagggttagagagctagaagctaaataaatgtagatataatatcattccaattgtaactaacttttcctcaatgctcatagtcatgtaatggct

SEQ ID NO: 422 - DNA, 1001 bp, Homo Sapiens
  allele 499: 12-609-233 : polymorphic base G or A
  misc_binding 479..498: 12-609-233.mis1, potential
  misc_binding 500..519: 12-609-233.mis2, potential complement
  primer_bind 711..729: upstream amplification primer, complement
  primer_bind 228..248: downstream amplification primer
  misc_binding 487..511: 12-609-233 potential probe
  misc_feature 87,106..107,568: n=a, g, c or t
ctgggaggcagaggttgcaatgagccaagattgcatcattgcactccagcctgggtgacagagaaagactccatctggaaaaaaaanaaagatgtcataaagttannttatattttttaaaaatacttaccaatatatggtctgaattgacatattttagaatttctttttttatttgtaaacagttttataaagaaatttcccccaatgattaggaccagaaagtatatttgttatgacagaaggggttggtcattattttactgagaaaaagagaatttagaacaaaagggacaacagcaacaaaaagatgagtatacaattttgatatgatatccaggaaacttatgggtctacatttcttttcctctttctctctctcttttttttttttttggtgtgagaatacattgagcgatgtggcattagagaatggatttaagtttaaaaacagggacacatcaggaaacacaagtcagaataattctcattcatttcraagcaaacacatattcaccaggagcttcatatagtgtgagggagctactctagggggtgagcagatctnccactggagaaagtcctggtgacctctcccactgtggttcaagtgccccctgtgagacacagcaaagtgatgatgagggtcccccacattcagttatacatagcacatcaaattcacagtgtgatttcaggacaaaaggtgtcatagtcatacctaagcaatgacctgagaaataagatcacttaattatgtaactatatagtatataatactgtattataaatggaattctcagaactatttcccagaaattccaaaccacaataccagactgctgaatgtcagtgattcttatacttcagcttttaaggtgtttttggggggtgggggtgtcgggggcagtgaggggtagtggggtaagactaggaaaccctaactttaagtgaaatataaagggttagagagctagaagctaaataaatgtagatataat

SEQ ID NO: 423 - DNA, 1001 bp, Homo Sapiens
  allele 501: 12-611-294 : polymorphic base G or A
  misc_binding 502..520: 12-611-294.mis1, complement
  misc_binding 481..500: 12-611-294.mis2, potential
  primer_bind 776..795: upstream amplification primer, complement
  primer_bind 251..271: downstream amplification primer
  misc_binding 489..513: 12-611-294 potential probe
  misc_feature 406,571,773,943..944: n=a, g, c or t
taaatcgtgcacactggaccaaaacttgtaagtaccaaatttcaattaatcttttgagagatgagacaataaataattcattcgaatgggctagatatagggaaagtaaatcttgcagagccattcatctctaatgtcttttagcaacatgccgaagcacacaagtaaagggccactaatccaaagacaaatgaggaatgtgaaagttaaaaatctcaggaccatcaagcaaggtctctgcaaagaaacagtaagtatagtcagcagtcagaaaattggcagacagcagacagtctttagtgaatgacagagagcacagggagggctaattgaaagggagtagtaattaacattttgtagcattgaacccatttcttgttgtgaagggcttctaacccccttagcntttcggaaaggcctctaaacctcttatctgtcagaagggcctctaactgtcctaagttgggcctctaaaccgattttgaacagtgtctctgttcragtataaaaatatgttccaccacttacccaaatcagccaattggtgttgcatagtctatttcctttgggnttggaatctcacctcatttaggtcccagcagagtcaccagaggaaaatattactggaaaagtggtcttgtcccagacgttaagggtgggtttgtggatctcatgtgggaaagaatgcaaggtgagtcgcagagtacagtaaaattaacagtttgttagagactactctattacagaatagggcatcctcagaaagcaagaangagaaatacccctaccttaaacttagtgcttgcttatataggttgttaagaatactgtactttattacaaaggtttgtgatcagcttgtgacaggctattaatattgttattttcctatgtattattgatttcagcaagattttacaagtgggctagttttttaaaggannaaactaattcttaaattaagaagtttttgttttcaaactattgggacattttcataa

SEQ ID NO: 424 - DNA, 1001 bp, Homo Sapiens
  allele 501: 12-612-41 : polymorphic base C or T
  misc_binding 481..500: 12-612-41.mis1, potential
  misc_binding 502..520: 12-612-41.mis2, complement
  primer_bind 461..481: upstream amplification primer
  primer_bind 981..1001: downstream amplification primer, complement
  misc_binding 489..513: 12-612-41 potential probe
  misc_feature 383: n=a, g, c or t
gtagaagctgagaaactagttaggagacatttcaccagttgtgacacaattcttctttaaatatgtcaaaatgggctgggcacagtggttcatgtctgtagggccaacactttgggagacagaggcagaatgattagaccacaggagttccagatgagtatgggcactacagcaagacctcatatctaaaaatgtaaaaaataaaaaatatagccaggcatggtggtgcgcagctgtagccccagcttctcatgaggctgaggtggaggattacctgagaccgaaacggaaaggctgcactgagccatgatcatgtgactgcactcagcctgtgtaatggagcaaaagcctgtctcaaaaaaaaataaaaactaaaaatatcnaaaatgatcattcccagattctatttccactatcttacttatagcacttagaatggctcacaatattttctgctctagaaaaacattaactttcccaccgaaaattccatttttcatytttaaaggtatttgtcaatgataaaactccaatttaaaaaccaaactttctgtaatgacatacattaaaacattaatattttatgtcaattcaatgacacttactttgaatcacttgtgtggcgcttttcaaagaccatccatagacttgatatgcttaagcaataaatttacttttaatgttgatatctttatatttatccttcagctataaagagaatatcatgaaattatcaagaattcatcatgatcaaccggtgaagcccctggatcgagcagtcttctggattgagtttgtcatgcgccataaaggagccaagcaccttcgggtcgcagcccacaacctcacctggatccagtaccactctttggatgtgatagcattcctgctggcctgcgtggcaactatgatatttatgatcacaaaatgttgcctgttttgtttccgaaagcttgccaaaacaggaaagaagaagaaaagggattagttatatcaaaagc

SEQ ID NO: 425 - DNA, 1001 bp, Homo Sapiens
  allele 499: 12-613-302 : polymorphic base C or G
  misc_binding 479..498: 12-613-302.mis1, potential
  misc_binding 500..519: 12-613-302.mis2, potential complement
  primer_bind 781..799: upstream amplification primer, complement
  primer_bind 343..363: downstream amplification primer
  misc_binding 487..511: 12-613-302 potential probe
  misc_feature 309: n=a, g, c or t
agaaagtgatagtgccagtagcagggggaagagagtagcagaataaggacaagggataaatgactagtagtacaatagtgattattactgatactagcatgatctcggctcactgaaacctccaccccccaggttcaagcgatctgattctcctgcctcagcctcccgagtagctgggattacaggcacctgccaacacatctgactaatctttgtgtttttagtagagacagagtttcaccatgttggccaggctggtcttgaactcctgacctcaggtgatccacatgcctcagcctcccaaagtgnctgggattacaagtgtgagcctccgttgttgttaacttgcagaaggtagacttgaatccaagtaaataattgtgaaactgattctctaattcttttgtacacaaaataattgttgcgacaaatttgcttgcttttccattatgtattagattctcagataatgtttgtatatttcaaaagaataagactsttgccaaaaagtatcaagtgtttgaaaaatgcatataggcattgcctttataatatactcacatgaaactgtacagagaataaatcatgatggtaagattcaatatcggtagcaaatactcattaaaaaaactctggaaataattcaaatatcttacattaagaaatggttaaaaacttacataatgtgcataccaagccattacaatccttttttcaaaacaatgtttaattacactgtcagccgtggtacaggtatagttggaaactaaggaacaaaatgatgagtagaacaagatcacagtttttttgtagaataaaaaggcatatacaatgagaataaaattttctaaataaacatcacatatgtacattgagttatataaatagaattaaacccataatgaaatggcacacattttaaattgagatagagatatgggtaaatgattttctttttctaaattttcatacttttataaaactacttacattgatcttct

SEQ ID NO: 426 - DNA, 1001 bp, Homo Sapiens
  allele 501: 12-614-471 : polymorphic base T or A
  misc_binding 502..520: 12-614-471.mis1, complement
  misc_binding 481..500: 12-614-471.mis2, potential
  primer_bind 952..971: upstream amplification primer, complement
  primer_bind 424..442: downstream amplification primer
  misc_binding 489..513: 12-614-471 potential probe
  misc_feature 109,479: n=a, g, c or t
gagctggattggtaaagtaaaatgaggacatgcacgttgcaagagtcaagatagaatgaaaccaaaattgagataaaatcaaaattgagataaacacatgaaatatttncacaaatacttcagtgaaacatagcatgaatgattaagaccagtaaaacaattagaaataagagagttttgggaataaagcaggcaatcgggagagcactaattcagcttttttttcttttttaacaaataacacttttatattttaatcaccttagtggcaattcctagagtattaggtgattcctattggggctctatgagtcaagattcagggagaaaaatagaaagattcactagttctttctactgctgttattgtttgttcttttgttcattcattcagttccattttatttcatgttatcaattacattttagtgtaaccagtgagtttatttctaatttctagaattgatgtgtttcttttntatgtttatggttctcgtcatwttccatacatatattatatgaactatttttcatctctggacatttgaactatgtttattataaaacatcattttgatttattttctatatctataatcctttggtgcaaatgttactattatacatagtatatagttgtatactattgtaaactattgtatattgtatatagttgtatactattgtatattgtatatagttggttatttcttcatttggttttcattagttaatcttcaacaggtattgatttctgcaaacattcttcatattctgcattgtgagaacatcagaataatttattgattgcctctgctgtaacctaggcagatcactttcattacaatttggcttttcttgtcattttttttacaatttattgttacaattaatttttatagcagaaattccctgaactctgtagatacatttttttcctagttttaaggtctttgtctcattttgattccttccaaaaccacttctttttatagctccta

SEQ ID NO: 427 - DNA, 1001 bp, Homo Sapiens
  allele 503: 12-620-192 : polymorphic base G or T
  misc_binding 483..502: 12-620-192.mis1, potential
  misc_binding 504..522: 12-620-192.mis2, complement
  primer_bind 309..326: upstream amplification primer
  primer_bind 777..797: downstream amplification primer, complement
  misc_binding 491..515: 12-620-192 potential probe
  misc_feature 461..463: n=a, g, c or t
tatgagaaaactacaagagtcaaaatttgatgtccttctggcagatgccgttaatccctgtggtgagctgctggctgagctacttaacataccctttctgtacagtctccgcttctctgttggctacacagttgagaagaatggtggaggatttctgttccctccttcctatgtacctgttgttatgtcagaattaagtgatcaaatgattttcatggagaggataaaaaatatgatatatatgctttattttgacttttggtttcaagcatatgatctgaagaagtgggaccagttttatagtgaagttctaggtaagtcgtgtgtccaattggtgtttattaagttctaattttcctgtgcctttgaaggtgggcttatataaatataatgtcagaagatagtgtttttatgggaaattatgaattgcaaatgtaagatgatctatgagtctcaaaaannntatagaatgttgaccttatagaatcagttagaaccctggkgccatcactgctacaggacaccaagagagtcataaaccttcaatgtaaaacacttatgatttctttaagccatcacatatcattttgctatacattttttcatctttaaaaaagtcaatagatacttcaagaaacatcttcatgaaggcagacatacaaattttatatttacacatatttctaaaaatattatcaatgcaggattgaggaacttgtacctgagtacctcagtttcctcatttagaaattaaattttgtttttcatataagaaggattccttcacagttgagaaatatagtggctctactccagaaacagaagcctaaaacttgagatttctaatgtttatacattccttcaataacaacttcacaattatttccttcaaaaactgaaatcttgttgaaagtgaacatctaagttttaatctatattttattaaactgcatctctccatcaaagaaaataggggccaaaataaggaagagcacatatct

SEQ ID NO: 428 - DNA, 1001 bp, Homo Sapiens
  allele 503: 12-621-49 : polymorphic base A or G
  misc_binding 483..502: 12-621-49.mis1, potential
  misc_binding 504..523: 12-621-49.mis2, potential complement
  primer_bind 455..473: upstream amplification primer
  primer_bind 907..927: downstream amplification primer, complement
  misc_binding 491..515: 12-621-49 potential probe
  misc_feature 634: n=a, g, c or t
aacttggaaatggtttgtgagatataaaatcaaaaataaaagcaaccaaattaaaattgattagttggacttcatcaaaatcaatacttttgtgcttcaatgaacaccgttaagaaagtaaaaggacagcccaaagaataaaaaaaaaacaaggaaatcatatatgtgataaggttcttatatcagaaagatattaaaaacacaagtccataagaagacaaataattcaaccaaaattaggcaaaacatgctcaacatgatttcatatcaaagaaaggtaaagcataaccagatatcacttcattcacactggctataatcaaacgaaatataatcccaagtgttggcaaggttgggaagaaattaaaattcttatacattgctggtgagaatggaaattgaagcatccactgtgaaaaacaatctggaaattcctatggtaatttagaaattatatggtaacagacaattcctatggtaatttagaaattatatggtaactrctactttgaattgtagcagttatactttcacttgattgatttatcttcagatataagtaggagaaaaacagaaagaaacagcgatttgaaaagaagcattgcattgcaccaggagaactatgaaatcgatngtcaaatattctcctgatacaactcagttgtcactttagttctgggagttgtggaaaggtgctagtgtggcccacagaatacagccattggatgaatataaagacaatcctggatgaacttgtttggagaggccataagatgactgtgctgtcatctttggcttccattattattcaccctagtaaatcatctgctattagatttgaggtttatccaacatctctaattaaaaataattttgagggtcttgttgtgaaactgatcaatagatggatatacgatcttcagaaagatgcattttggtcatatttctcacaagcacaagaactcttttgggaatctacagactgtgttaataatctctgt

SEQ ID NO: 429 - DNA, 710 bp, Homo Sapiens
  allele 364: 12-622-325 : polymorphic base C or T
  misc_binding 344..363: 12-622-325.mis1, potential
  misc_binding 365..384: 12-622-325.mis2, potential complement
  primer_bind 40..59: upstream amplification primer
  primer_bind 551..569: downstream amplification primer, complement
  misc_binding 352..376: 12-622-325 potential probe
  misc_feature 333,685,688: n=a, g, c or t
tattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctnctggacactgccatcaagaccacatgattgygtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaaagaaaanaanaaaagacagagtttcaaatgct

SEQ ID NO: 430 - DNA, 1001 bp, Homo Sapiens
  allele 501: 12-624-82 : polymorphic base T or C
  misc_binding 481..500: 12-624-82.mis1, potential
  misc_binding 502..521: 12-624-82.mis2, potential complement
  primer_bind 562..582: upstream amplification primer, complement
  primer_bind 114..134: downstream amplification primer
  misc_binding 489..513: 12-624-82 potential probe
  misc_feature 464,639: n=a, g, c or t
tgtcttatgtcaacattttatgaattctacagtagtttagtgatttcttctaatttttaaggttatatttgcagtaattttgagatgtgattacaaatgcattggcaatcctctcatcaagtcatatacccttcctgtgaaatttagcaaattttgtggctgtctcaaaaaagagaatatagtggaagtgaggagcttaacttccaaagctcaaaaaaattgttaatacattttctctgtctgtccttctgtccttttctctgtgtttctgtcattcttttttcctttttctctgtctctccactcgctttggagccctgtgctatatccacagtccccaggagaaatataccatttggtgtagaaatacatatgtatgcctaataagtcacaattggcccagcactgcagtagcttgagacttttaatactaatcaccagatatgtgagtgattaaccttcangatgattagcccaagctaccttaggacagtaaccaaytgagaaatgctgtgccataaacacctaattgagcctggccaacaacctagaattaaaacagatgatgataaaatgttgctgttctaagcaccttcatttcagagcagttggttaagcagtgatagacaaccagaaaanatatttttacatatttgagttatactcctgtaataatattaaaattaatatatacctacaaaaaaagtgaatctatattacattttgtaactacctgtaacccagaaagagtagtcagcataggatggtgggtaagagcttgcactctgaatccagataacctatatcatctttgcaaaaccattacagaatcatgtatagttaagcaaattacttatcaggtctatgcctcacattctccttcagtgaaatgtagatgaagcaatgtcactacctacttaatagcattgctgagactaaaagagttgctgtatgtaattgctgtatatagcaaaattcaatttgctataactattattatt

SEQ ID NO: 431 - DNA, 1001 bp, Homo Sapiens
  allele 501: 12-624-83 : polymorphic base G or A
  misc_binding 481..500: 12-624-83.mis1, potential
  misc_binding 502..521: 12-624-83.mis2, potential complement
  primer_bind 563..583: upstream amplification primer, complement
  primer_bind 115..135: downstream amplification primer
  misc_binding 489..513: 12-624-83 potential probe
  misc_feature 465,640: n=a, g, c or t
atgtcttatgtcaacattttatgaattctacagtagtttagtgatttcttctaatttttaaggttatatttgcagtaattttgagatgtgattacaaatgcattggcaatcctctcatcaagtcatatacccttcctgtgaaatttagcaaattttgtggctgtctcaaaaaagagaatatagtggaagtgaggagcttaacttccaaagctcaaaaaaattgttaatacattttctctgtctgtccttctgtccttttctctgtgtttctgtcattcttttttcctttttctctgtctctccactcgctttggagccctgtgctatatccacagtccccaggagaaatataccatttggtgtagaaatacatatgtatgcctaataagtcacaattggcccagcactgcagtagcttgagacttttaatactaatcaccagatatgtgagtgattaaccttcangatgattagcccaagctaccttaggacagtaaccarctgagaaatgctgtgccataaacacctaattgagcctggccaacaacctagaattaaaacagatgatgataaaatgttgctgttctaagcaccttcatttcagagcagttggttaagcagtgatagacaaccagaaaanatatttttacatatttgagttatactcctgtaataatattaaaattaatatatacctacaaaaaaagtgaatctatattacattttgtaactacctgtaacccagaaagagtagtcagcataggatggtgggtaagagcttgcactctgaatccagataacctatatcatctttgcaaaaccattacagaatcatgtatagttaagcaaattacttatcaggtctatgcctcacattctccttcagtgaaatgtagatgaagcaatgtcactacctacttaatagcattgctgagactaaaagagttgctgtatgtaattgctgtatatagcaaaattcaatttgctataactattattat

SEQ ID NO: 432 - DNA, 989 bp, Homo Sapiens
  allele 489: 12-624-107 : polymorphic base T or C
  misc_binding 469..488: 12-624-107.mis1, potential
  misc_binding 490..509: 12-624-107.mis2, potential complement
  primer_bind 575..595: upstream amplification primer, complement
  primer_bind 127..147: downstream amplification primer
  misc_binding 477..501: 12-624-107 potential probe
  misc_feature 477,652: n=a, g, c or t
tttaaaattttaatgtcttatgtcaacattttatgaattctacagtagtttagtgatttcttctaatttttaaggttatatttgcagtaattttgagatgtgattacaaatgcattggcaatcctctcatcaagtcatatacccttcctgtgaaatttagcaaattttgtggctgtctcaaaaaagagaatatagtggaagtgaggagcttaacttccaaagctcaaaaaaattgttaatacattttctctgtctgtccttctgtccttttctctgtgtttctgtcattcttttttcctttttctctgtctctccactcgctttggagccctgtgctatatccacagtccccaggagaaatataccatttggtgtagaaatacatatgtatgcctaataagtcacaattggcccagcactgcagtagcttgagacttttaatactaatcaccagatatgtgagtgattaaccttcangatgattagccyaagctaccttaggacagtaaccaactgagaaatgctgtgccataaacacctaattgagcctggccaacaacctagaattaaaacagatgatgataaaatgttgctgttctaagcaccttcatttcagagcagttggttaagcagtgatagacaaccagaaaanatatttttacatatttgagttatactcctgtaataatattaaaattaatatatacctacaaaaaaagtgaatctatattacattttgtaactacctgtaacccagaaagagtagtcagcataggatggtgggtaagagcttgcactctgaatccagataacctatatcatctttgcaaaaccattacagaatcatgtatagttaagcaaattacttatcaggtctatgcctcacattctccttcagtgaaatgtagatgaagcaatgtcactacctacttaatagcattgctgagactaaaagagttgctgtatgtaattgctgtatatagcaaaat

SEQ ID NO: 433 - DNA, 1001 bp, Homo Sapiens
  allele 501: 12-624-146 : polymorphic base T or C
  misc_binding 481..500: 12-624-146.mis1, potential
  misc_binding 502..521: 12-624-146.mis2, potential complement
  primer_bind 627..647: upstream amplification primer, complement
  primer_bind 179..199: downstream amplification primer
  misc_binding 489..513: 12-624-146 potential probe
  misc_feature 529,704: n=a, g, c or t
tagaatgttaattaaaatttttaattatggctaaaattttagtaaacaaatttttaaaattttaatgtcttatgtcaacattttatgaattctacagtagtttagtgatttcttctaatttttaaggttatatttgcagtaattttgagatgtgattacaaatgcattggcaatcctctcatcaagtcatatacccttcctgtgaaatttagcaaattttgtggctgtctcaaaaaagagaatatagtggaagtgaggagcttaacttccaaagctcaaaaaaattgttaatacattttctctgtctgtccttctgtccttttctctgtgtttctgtcattcttttttcctttttctctgtctctccactcgctttggagccctgtgctatatccacagtccccaggagaaatataccatttggtgtagaaatacatatgtatgcctaataagtcacaattggcccagcactgcagtagcttgagacttttaatactaatyaccagatatgtgagtgattaaccttcangatgattagcccaagctaccttaggacagtaaccaactgagaaatgctgtgccataaacacctaattgagcctggccaacaacctagaattaaaacagatgatgataaaatgttgctgttctaagcaccttcatttcagagcagttggttaagcagtgatagacaaccagaaaanatatttttacatatttgagttatactcctgtaataatattaaaattaatatatacctacaaaaaaagtgaatctatattacattttgtaactacctgtaacccagaaagagtagtcagcataggatggtgggtaagagcttgcactctgaatccagataacctatatcatctttgcaaaaccattacagaatcatgtatagttaagcaaattacttatcaggtctatgcctcacattctccttcagtgaaatgtagatgaagcaatgtcactacctacttaatagcattgctgagac

SEQ ID NO: 434 - DNA, 1001 bp, Homo Sapiens
  allele 501: 12-624-288 : polymorphic base T or G
  misc_binding 481..500: 12-624-288.mis1, potential
  misc_binding 502..521: 12-624-288.mis2, potential complement
  primer_bind 769..789: upstream amplification primer, complement
  primer_bind 321..341: downstream amplification primer
  misc_binding 489..513: 12-624-288 potential probe
  misc_feature 113,671,846: n=a, g, c or t
gttttaatataatattatcaatccattagtgccatttagaaaacttaaattgaccagcaatccggtgctctctatctgataaatttacagcctgtttttggacacctacttgnatattttaaatatttattaataaatatattagaatgttaattaaaatttttaattatggctaaaattttagtaaacaaatttttaaaattttaatgtcttatgtcaacattttatgaattctacagtagtttagtgatttcttctaatttttaaggttatatttgcagtaattttgagatgtgattacaaatgcattggcaatcctctcatcaagtcatatacccttcctgtgaaatttagcaaattttgtggctgtctcaaaaaagagaatatagtggaagtgaggagcttaacttccaaagctcaaaaaaattgttaatacattttctctgtctgtccttctgtccttttctctgtgtttctgtcattcttttttcctttttctckgtctctccactcgctttggagccctgtgctatatccacagtccccaggagaaatataccatttggtgtagaaatacatatgtatgcctaataagtcacaattggcccagcactgcagtagcttgagacttttaatactaatcaccagatatgtgagtgattaaccttcangatgattagcccaagctaccttaggacagtaaccaactgagaaatgctgtgccataaacacctaattgagcctggccaacaacctagaattaaaacagatgatgataaaatgttgctgttctaagcaccttcatttcagagcagttggttaagcagtgatagacaaccagaaaanatatttttacatatttgagttatactcctgtaataatattaaaattaatatatacctacaaaaaaagtgaatctatattacattttgtaactacctgtaacccagaaagagtagtcagcataggatggtgggtaagagcttgcactctgaatcca

SEQ ID NO: 435 - DNA, 1001 bp, Homo Sapiens
  allele 501: 12-624-293 : polymorphic base T or C
  misc_binding 481..500: 12-624-293.mis1, potential
  misc_binding 502..521: 12-624-293.mis2, potential complement
  primer_bind 774..794: upstream amplification primer, complement
  primer_bind 326..346: downstream amplification primer
  misc_binding 489..513: 12-624-293 potential probe
  misc_feature 118,676,851: n=a, g, c or t
cttgggttttaatataatattatcaatccattagtgccatttagaaaacttaaattgaccagcaatccggtgctctctatctgataaatttacagcctgtttttggacacctacttgnatattttaaatatttattaataaatatattagaatgttaattaaaatttttaattatggctaaaattttagtaaacaaatttttaaaattttaatgtcttatgtcaacattttatgaattctacagtagtttagtgatttcttctaatttttaaggttatatttgcagtaattttgagatgtgattacaaatgcattggcaatcctctcatcaagtcatatacccttcctgtgaaatttagcaaattttgtggctgtctcaaaaaagagaatatagtggaagtgaggagcttaacttccaaagctcaaaaaaattgttaatacattttctctgtctgtccttctgtccttttctctgtgtttctgtcattcttttttcctttytctctgtctctccactcgctttggagccctgtgctatatccacagtccccaggagaaatataccatttggtgtagaaatacatatgtatgcctaataagtcacaattggcccagcactgcagtagcttgagacttttaatactaatcaccagatatgtgagtgattaaccttcangatgattagcccaagctaccttaggacagtaaccaactgagaaatgctgtgccataaacacctaattgagcctggccaacaacctagaattaaaacagatgatgataaaatgttgctgttctaagcaccttcatttcagagcagttggttaagcagtgatagacaaccagaaaanatatttttacatatttgagttatactcctgtaataatattaaaattaatatatacctacaaaaaaagtgaatctatattacattttgtaactacctgtaacccagaaagagtagtcagcataggatggtgggtaagagcttgcactctga

SEQ ID NO: 436 - DNA, 1001 bp, Homo Sapiens
  allele 501: 12-421-135 : insertion T
  misc_binding 481..500: 12-421-135.mis1, potential
  primer_bind 367..385: upstream amplification primer
  primer_bind 797..817: downstream amplification primer, complement
gttcttgtctcattttgatacagatgaacctagtgtcaaatgagttggaggaagcatcctgttctactttctcagataattttaataaggttggaagagtgtgttccttcaaggttgtgtagaacttgccttaaaataatctgggcctaatgtttttctggtgggaaatttttaaattatgggatttgcattctttaatgattattggactaggcaggctttttgttacatcttgaatcaattttggtaggccttggtccttgagatgataacattggtctcttgattatccacttgctccaaggagggttttacagactactccctaggcttgaaagcgtggggtgaataccaccgggagtacacgagataattgtaagaggtgtgtagacttggttttaaataacattgaactacatgatgagaagtcattctcatttcaattatctttgaatccttatggttaagtcaagtggaaagtattggtttggagccagcatgtcccacacctcaaaattaatgtttatttttatcaaagtaatttatgtacgtgatctgaagataaagtgggattacaggttttatgacaacaaataactcttccttgtccctacctcccctctccctctatccctagagataaccctttttgattactactttgggtatttacttctgtatttctaaacattatactttcactgctatttattgattcacaaattttagacattgtcagttggcttctttttatggaagaaataatttcatgctcctttacttcttcttttccttacctcatccttccagtaacattatatcactctgttaggttaaatcaatagccaatgtttataattattgtgattaagaaaataatgttgaaagcagggccttatagtatactgtggttacatttccttcttgtgcaattttttttccctagggttaataattgctctttatttctttgtttgcttagtttcatgcccaaatcttct

SEQ ID NO: 437 - DNA, 1001 bp, Homo Sapiens
  allele 501: 12-442-133 : insertion C
  misc_binding 502..520: 12-442-133.mis1, complement
  primer_bind 616..633: upstream amplification primer, complement
  primer_bind 184..203: downstream amplification primer
  misc_feature 94,734: n=a, g, c or t
ttagaattctttttggcattaatcaaaactttacagaggacataaacactgattttttccccccattcatttaactatttgcacacagagacangaagccagaaatctgactgggaagaaattcctacccttttgccagcatgctaagcttctgggttctctttccctgagtggccctagtgatctggcttgtggcacaactgcctttgggggccaagccgcatcataaaggaaaagtatttctttttgttctggccaaagcaaaatacgcgtaataaaacatagatattaaccaggctgcttagcatccaatatcaaactggcaaggcttaaatttgccctcaggtgggccctgtcatctttaatctaacctccgactaggagtttcaacatgtggtctctgggcaagatggtcgccctgagtaatagaaaagaaagagaaaggagagagagaaaaacattgcctgtggcagggcggggaaggtgaaatgatcagggaggcagagaaagaaccacccattgcagcgacactaaaaagttcaggtggctgctgtcggtggagcaaggatcttttccagtaatcctaccagctctcaaatttcccttgttagggaggaaaaagctccccatgtcccaggatcctgtacattcctaattctgtcacccatagccatcagcaaagtacaagggagattaatccaaagagaatagcagttaacatcccatagtgccgnaacctgttcttagccgagagggactttaccgaagaggggcctctaacccgctaaatcttagaagggactctaactctcctaagtcgggcctctaaccagaggtcagtcaagcatccttgccttttattaagggggagcctttaaccacctctatcttaggagagactctaactccactaagctgggcctctaacccaatcccattctttacccaggtaccccaccacttacccaaagtcttccaatcagtgctgcagtctatttcct

SEQ ID NO: 438 - DNA, 756 bp, Homo Sapiens
  allele 501: 12-449-63 : insertion AT
  misc_binding 481..500: 12-449-63.mis1, potential
  primer_bind 546..563: upstream amplification primer, complement
  primer_bind 86..106: downstream amplification primer
  misc_feature 123,277: n=a, g, c or t
ggggacggaagaaaggaaaagaaaaaatagtttatatgtatatacatttgtatcaaaataagaaataaatactcataattattacaattttcctctgaaagtagtcacatggttatacctggntatttatttattttttattattattattattatttgagacagggtctcaccctgtcacacaggctggagtgcagtggtgcaattatggctcactgctacctctgccacctgggctcaagccatcctctcaccttagccttctgaacagctgggnatacatgtgcactaatttttttttttttgaaacaaaaatatttgtgtagaaggcacaaaagctacaatcacagactccactgtgcaaaggcgcaacctgcctcattgatctctagtgtacaccaacccagcttccctttccattcagcctgtgaaaggagatagtgcttgggccatttggtaaaagaaggggatgggagatgatcaaaaccccaagtaaggttcatccaatatggtgtctaagcagcaaatgactaattgctgaagaaggagactagacagaggattagaggcagccatggggccagtgcagctgtggagagctctgagcaaagaaacaaggttggcaggtgaggaggcctaggatagaggccagaaggccaagcctggggctgcatgtgcactaatttttgtatttttttgcttttttgatagagatgagatttcatcatgttgcacaggtgggtcttgaagtcctgg

SEQ ID NO: 439 - DNA, 1001 bp, Homo Sapiens
  allele 501: 12-454-242 : deletion  AT
  misc_binding 481..500: 12-454-242.mis1, potential
  primer_bind 260..279: upstream amplification primer
  primer_bind 755..773: downstream amplification primer, complement
  misc_feature 795..800: n=a, g, c or t
caaatggaaaaaatgaaaactgtcacacttcttacataacttcttttattatctgtattgtaaatacagagtctcaattattgactaatttatactaatagtgggaagcagtgtctagataatcccagatgattactaatttaaaactactttacattttatttagtaatgtgtttggaacagttacattttgtagctacttacaattttactttaactgaaataataagacaaggccataaatattggcctccctggctggggagttgtgtgggtttcctttccaggcagttgaggttttccatggagcctactctacagtgtcagcaggagtataacatagaaggcttccaggtcaggtggcccagagtcaaatcaaagccccatccctttttagcaaatttctcagccttacttagctgtgccggcctgcctctttctaaaatgaggaaaataataatacccacttcactggtttattgagaggattaaatgaggacatgtgttatttcacaccattattgcttctgttgttattattttaaaatctaggttggtgattgcatcagtttcttagggctgctctaaagaaagtaccacaagctgagtgacttacatagcagaaaagtgttttcttacaggttaagaggctggaagtctgaaatcaaggtgtcagcagggccatgctcccactgaaacccatagcggggaatcctttcttgcttctaagtttctagtgtttccttggcttgtagatgtgtcacttcagtcacacggccatcttcttctttcttnnnnnncttcttcttcttcttcttcttcttcttcttcttcttcttcttcttcttcttcttcttccttcttcttcttcttcttcttcttcttcttcttcttcttcttcttcttcttcttcttcttcttcttcttcttcttcttcttcttcttcttcttcttcttcttcttcttcttcttcttcttcttcttcttcttctttgagatgg

SEQ ID NO: 440 - DNA, 1001 bp, Homo Sapiens
  allele 501: 12-463-230 : deletion  CAT
  misc_binding 481..500: 12-463-230.mis1, potential
  primer_bind 255..272: upstream amplification primer
  primer_bind 773..790: downstream amplification primer, complement
  misc_feature 136,400,713,730: n=a, g, c or t
aatcaatgcataaacaaaaaggatgccccagaaaacctgtgcttttcagacacacacacacatacacacacactcactcactcactcactctgaattgggtcaagtaaaaaaaaattttttttaaaggaaggaatnctttagcccaactgggatttcgacgaaattgtatatatcaaaagatagctacatccaacctctcaccagaatccagaggctttctcctgcaaagatactattgaaagttttattagtaagtttgagaaggcgaaagtatgtatcagaggtgaaagctaacatgacaattgcttggccaaagagcgcagcagttttatgttattgagcagcacaggatgaatcgaacacccacgatggctagacagaggcgcctggctgtgactnccagaggttcaggcaagccatctgacctctctcagtccccaccccctgaaatgaaaaccatactcataagactccttgacaatggaaattttggaggtgacatagttaatgaagtgtcatagaaaggaaatagctaagaatactctaaaacctccccattcccagtatgggcaatttgggaaaaatgagtaactaaaaattaggggttctcaaagtgtggttccaggatcaaatgcattagtccccacctgggagcttgttagaaatgcaaattcccaggctcccctctaggcctcctgaattagaacttttngggggtgttttaacaangctctccaggtggttacgatgtcccatagagaatcattggggcaaataatcctgtgccctgattagattgcaaagctgcactttcaaaagcaagtcagggtgctgagttgcttagtttctattgcaaaatttcctgctttggaacaaaattttcaaaattttcagagggttgctcaggccagtgatgtttgcaatgcaaacccaagaattctgaaaggagcccatggctgaaaggagccaattcttccaggacggactactccagttgcaa

SEQ ID NO: 441 - DNA, 1001 bp, Homo Sapiens
  allele 501: 12-462-199 : insertion  ATGTCCCACAGCTG
  misc_binding 481..500: 12-462-199.mis1, potential
  primer_bind 303..322: upstream amplification primer
  primer_bind 736..756: downstream amplification primer, complement
  misc_feature 255: n=a, g, c or t
caaaagcaagtcagggtgctgagttgcttagtttctattgcaaaatttcctgctttggaacaaaattttcaaaattttcagagggttgctcaggccagtgatgtttgcaatgcaaacccaagaattctgaaaggagcccatggctgaaaggagccaattcttccaggacggactactccagttgcaactgtgctgtggaggctgaggagcatccatgactgaggaagggcgagtcccctataatgcccttgctanggggagcatcagacatccctagacttacaagtccctcgtgtaataaggtgaactatggaaagctatgatttgaggaaagttccctctgattgaaagagttcttcaaatatgaagaatgtaacacttatggggcacctactcattgcaaaacactctactaggggctttcacctgtatgtttaactcattttgttgatttttttttttttaagcccaaatttctgagaggttaaggaacttgtctggtggtggcgtctctgggattctgacttttccactgaccataacatgcatctggtctaaattgagcggaccacccaggaggacgttggaataaaaagaaatgggaagggggtggggagaggaatgggcatagaataaaaaggtagaaacccttgggatcaaaggatgcaactgaaagagcaccaaaatatgcatcattttttttaatatgttgtctggtacccaaaattgggatgcctctgtggtatcaactttgacatttaaagaaagggcataagattagatcattcaaccataagtggaaggaagaaacaaaataaaataaaaccttacaattccctttgaagttgatcaggtgtcaaggcagtgatttggttttcttttacaaactttctttttccagaaaaatttttactgtgggtttggagaggtgtttacaataaattcatagcagagctccaaaagggcccaccccatctaatatcctctgtctcagcagatta

SEQ ID NO: 442 - DNA, 1001 bp, Homo Sapiens
  allele 501: 10-430-287 : insertion T
  misc_binding 481..500: 10-430-287.mis1, potential
  primer_bind 215..233: upstream amplification primer
  primer_bind 617..635: downstream amplification primer, complement
  misc_feature 938,965,972: n=a, g, c or t
cgaacaatataattatttaaattatattttgcatggccatttgttaatgctagttctcacatgtctgtaaaattaggatttttaatatcaattaaatgaaggactttgttttgttcactgttacatctccattgcctagaacattgacatataaatatttgttaaacgaatgaatgaaataacattctgacaattgaagaagagattttaagaatagctgtaacacatcatacataaaaatgttaagcataaatatttgtaatatatgtaccgaaatttattgaccctcacatgtttggcagattcttaattttttcttactggctttacttagggacgtgcttccttaacacaagagaaagagaagtttgcccatgaacatgaagaaatgaagaacctagaagccattgttcaagaaataaaaccaactgccctcataggtaagcattttctcctctcccttctcccctaccccttattttgacctgattgttttttttactaccaatttttgaggtataatttagcctttttgaattcaaaaaactacacgttcgctcaagcgacagtaccctgtagagacctagatttttaactttagtcctgtcgtctttctcttactgatctgagatgaagcgtatggccccctcctctaactcagcctgttaatacctggcacgttcagcacttttctaggcttgattactccagatagacagtggttctcaaataagagggatttttgccctgcaggaaacatttggcaatgtctggaagctttgagttgtcttaactagggtagcggggttggaagggagtaaagggaggggctactgacatctagcagatagaggcagcggaatgattctactaaatatcctgtagtgcactggacagcccctgcgacaaggaattatccagcctaaaatgtcaatagntgctgaggttgagaaatactgcagtangataagnaccctcctggaagacagggatcacatctc

SEQ ID NO: 443 - DNA, 1001 bp, Homo Sapiens
  allele 501: 12-718-432 : deletion  T
  misc_binding 481..500: 12-718-432.mis1, potential
  primer_bind 913..932: upstream amplification primer, complement
  primer_bind 479..499: downstream amplification primer
  misc_feature 346,853..854,883..884: n=a, g, c or t
gtaaccttggaaaaattacttaccttcctcaaggcttaattttcttgcctgtaaattggggtaaaatgctaatagtaccttcagtagtaccttcagacagttgttatgatgattgagagaaaacatataaaacaaattacttttatcaagtgctataaatagtaactataatttttatttttcaggaaggattactaggaccataatttagttaaaagatgtaggctggcaaatttggcttaatattaaatagagcatttaatagttggaattgtccccaaagaaaataatgtatataaaagtacttgcacataaaaattactcagaggttgttattccttattgntttctgttgttaatattatttgtgaactctccatcactctgagaacatggacagatgtgcttaaagatataaagatttctacttttatgtgagatgatggattagaattaaatgtttctaaagtgttccaactttaggattctatgaaagtggtaaaaaaaaaatcgtattttgtttcaacattcaggactggttgtttcataaaattcagtgattcagccatgcttgtgatcattatgagtcagttgaaattgatcatcacaatatatttgacccagaggaataaacttctcattcaacattgtaaattattttgttttgcataacaaaacaactttaataaacttcagtaagctttagctttcccttgctacccaaagtttatttcataaagagctcaagagacaattggcaagttaaataattcaagagaaaaaatgttcacaagaagtttttatttgctttgcattctattccctatgctacatattaattgtacagttagcnncaaagtaagttttgtagtaaaaattactnncacaataaaaaaggtacatagatacaagcaactagcaaattaacttcgcaaagaataagatgtgggtttacataagccatttatgccagttaactagaccagttctcaactctctct

SEQ ID NO: 444 - DNA, 1001 bp, Homo Sapiens
  allele 501: 12-269-301 : deletion  T
  misc_binding 482..500: 12-269-301.mis1
  primer_bind 204..222: upstream amplification primer
  primer_bind 634..654: downstream amplification primer, complement
  misc_feature 626: n=a, g, c or t
acacagaggcaccatctgtgtcactctgtgtgtggtctgccatgttgtggggtggtcactacagactcaggcagctgggcagacaataccttagccttagatgatgctgatgcagcccaggagtcagaaactgtagtgcagacaatgccctccttaggccaacacaattaagtgcaatagatgactggcttttctgttagcctcttcattggaaccaaaagcagcattactctaccaaacagaggggagctggaaagaaactacacagtttgcccagcctagcctctgccttgacacggaaccatgtgagtctagacattcacctagatcattccttggggaccaatgctgctgacacattaactcaatagtttgtcctggcctgagaggtcatgtaacttgtagaaagtttagaagcagagattagtgtcatttatttgccatggctgtgacaacaaaggaaggaacaggagtgggaaaacccaaggccaccctggttttggtagatggtgcacacgcttccactaactgttctggggcaaagatccaaatgcactattgggcctggctatgctgcttctgctgggtcccccaaacatgagcctccacgccatttctcagttgtnattttaccacatattatcacagtcaccggatttgtacagaatatttggaacctatactgtcttaagggctaccctttaaagaagagaaaacaaggttttaattcaactgtctggaacattttatgtttacttatgtggaatactacatcttttgttataaacaggagggaatgtggacattcgaaggcccctaccttttagctaaaagcccatatgaagcatatggatccatttatacacaccatgcttttcagctacattttcctaatttgcctctctggggccaaccttgtgggactagcagattcatggttgagttgaaggatggtgacctcttccatcagcttttcttcttcctccagtcttccaaccctc

SEQ ID NO: 445 - DNA, 1001 bp, Homo Sapiens
  allele 501: 2-13-398 : insertion G
  misc_binding 481..500: 2-13-398.mis1, potential
  primer_bind 104..121: upstream amplification primer
  primer_bind 506..525: downstream amplification primer, complement
tgagctcccatcccgcatcctgtgtggcactctgtccatcaagcccagtgtgaaggagttcacggaaacctcagctgtgtttgaggatgggaccatgtttgaggctatcgactctgtcatctttgcaacaggctatgattattcctaccccttccttgatgagaccatcatgaaaagcagaaacaatgaggttaccttgtttaaaggcatcttccccccactaatggagaagccaaccttggctgtgattggcttggttcagtcccttggagctgccatccccacagcagacctgcaagcctggtgggctgctaaagtatttgcaagtaggtgggccattctgtctttcattcattttatcaatgaacatttactgaacacctgctatatgcaaagcactgtgctagggatacaatgagaacaagacaaacatgttccttgacctctcaaggcttaaaatggggtgtgggggatgccataataggggaaatttgggggggttctagtgaggggagttggactgttgcacagagcaaacagtatacaggaagtcataaaggtgagggaaagcatgaaatgtgtaaggacccagaaacattttggtggaagggaatataaagcagaggcagggagtggcaagaaatataggtttataagccacgttaaagagcttaaacttctcatagggattaaggacttcgcaagattttaagcaagaaaaaaatagcagaggataactgcaatgtcaggctacattataaagattggaagggccctggtgagggttggaggtgtgccagaaacctcactggtgtcaacttctgtcagaataacaaagtcaggccactctgattctcatgacaatcttcttcttctctccctctactctagacctcatggtctccaggggctacaagtatgcttatgtgaggaaatcaagaatatgaggattacatggagaaaggcaatgtctcaaatatattaatttactccagtcatac

SEQ ID NO: 446 - DNA, 1001 bp, Homo Sapiens
  allele 501: 2-28-132 : insertion T
  misc_binding 481..500: 2-28-132.mis1, potential
  primer_bind 370..387: upstream amplification primer
  primer_bind 769..793: downstream amplification primer, complement
tattcagggagttaaaggaagacaaaggtttttaaatggggaaaaaatacaattacataattgttttgaaataattatataaagagcaataacaagggtgatgccagtctgagattggacagttactgagcagatgttcttgtagaagtcatttttgtgtaagattatgatggtctttgtgtaaggtggtggtttttgtagtttttgttatcaggcacacatcatgagaacccgctctttctggcctttcccaattctatttgtcgggtttcttaacattagtgactccatctagattctgacagttttcatgagaacttgcttttcttttctctctcaagtccttattcagtattcagcacccttaacagattagtcccactgctgagtcaggcctcttgcatgaagcagcaatgagaaagacacacttggccaatgttatcctggagtaattctcaatgatgccttctctgtgtttcttcaagacaactgtccttagtgtgagaaaatgtccagatttctcatcctctggccaatggaaggttgtcactcagagcaacggcaaggagcagagtgctgtctttgacgcagttatggtttgcagtggccaccacattctacctcatatcccactgaagtcatttccaggtgagacccgctgggattcccagctttttggagtaggtttccaggtactttatatgtagtttggattgacaagcaggattcattgctgcaactgggcagaacttggctcaataagattgagacagagctagaaagatgaaagacaccaaacatcatctttgtttctattggcctctgagtcttcatcacacatagatctcagagccaacttccttggaagtcactaagtccttggcataattttagagaattcacatcaaactggttctctgttggagaggcccttttagccatgtgcctgcgttggcctttttctaccctgccaaacaccgagcctttttcacagggccata

SEQ ID NO: 447 - DNA, 1001 bp, Homo Sapiens
  allele 501: 2-39-27 : deletion  ACAATGACAGCATCATCATCA
  misc_binding 481..500: 2-39-27.mis1, potential
  primer_bind 475..495: upstream amplification primer
  primer_bind 870..892: downstream amplification primer, complement
ccagggacaagttaagtcccaccattagtgtaccaaatcccagtacttacatacttaccttgatgtgtatatgctgcacaccaaggtaaattacaaatcaaacatattctgatttttgaaaacatacttgaactaatagtcattttaaaggcttactctctgggtataattaagcttgaaatcatccaaatattattattttcatagctgcagcaaagcagctgaatttcacagagctaacaatgctgtctctgtgctgaatacttaataagccagaaatgaggcaaaaggtgagcccaatgagcaagcagtatactcagtgatacacaggacctccaggtcaaagggttataccatgttgaaaatcaaggaaaaagacatattctttcagaaatttctctctgcttcagtccaccaacctctcatggaatttattctctgtacctgtgggagtcatttcagtgttatgaaccagcaatcaagacaccttatctggtccaacaatgacagcatcatcatcatcatcattatcatcattacaatcatacacagtatttactatatatacacaaatctcttgacatagattatctcatctaatccccaccacaactatctgatgcagatgttattatgcctgttttatttattttttagaattttttattttatttatttcaatagcttttgggggagcaggtggtgttttgttacctggataagttctttaatggtgatttgtgggttttggtgcacccatcatctgagcagtgtacactatacccaatgtgtagtcttttatgcatcaccccccactccaacacttacccccaagtccccaaagtccattgtatcatttttatgcctttgtattctcatagcctagctccaacttatgagtgagaacatagaatgttcagttttccactcccaagttacttcacttaggataatggtctgcaactccatccaggttgctgtgaatgccattatttcatccc

SEQ ID NO: 448 - DNA, 1001 bp, Homo Sapiens
  allele 501: 2-45-155 : insertion GAC
  misc_binding 481..500: 2-45-155.mis1, potential
  primer_bind 347..367: upstream amplification primer
  primer_bind 764..788: downstream amplification primer, complement
ttatgttctctgcccagtgtcccagggtttattggtttctaaagaggtagtgggtatatacagcctccccaaggggaatttaggaagtaagctggttgtcacaaagactggcattaaataggtagagacctaggatgctaatatcttgcaatgtgccaaaataattgtccctgtccccaacctcaccattgccaatattacccctacccctcacagtgagcgtcacaggcaggcaacaaactggtgtcgtcacagaatgattgatggaacacatagactgcattcattacctaaacattgtcgtcacactgcagcaaccaaagacaatcgcattacccaggggttagatgtaggaagagtaaaaaacaaaaaatttttgaatgcgtaattatcactaattattttatttgatccttcaggagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccaggtattgtatttttggggaaatgggtttctctgcattagttcagctcatatttagatagaaaagttactctgataatgaaagcaattatgaatgaagtatcccattctaagtatttgttgaaatataacagcctcatataaaacccaaaaagtagtgtcattacccttggtattatagattatatacattaattgaagaggaaaatcatctgttaaaattaaaggtttgaataataatatattgatgtcaaaacttttttttttttttttctccctgagacagagtctcactctgttgctcaggctggagtgcagtggcatgatctcagctcactgcaacctctgccttccaggctcaagtgattctcctgcctcggcctccagagtagctggg

SEQ ID NO: 449 - DNA, 1001 bp, Homo Sapiens
  allele 501: 2-4-391 : deletion  G
  misc_binding 481..500: 2-4-391.mis1, potential
  primer_bind 111..132: upstream amplification primer
  primer_bind 513..537: downstream amplification primer, complement
ttatccctatatgttcatttgtgaatgaatatttattacatcattataaaaaggatttttaaactatctgtatgtttaagagtatatgttgctactatgtaagagtatatgctgttactgtaaagacattgcattactactgttgacctcagagcacgcgcctcttgcctaattctaggactcctaactaagtctttggagtttcagctggaagaatgctggaggaatacggaactcctcccatttctcacagccacctccaactcttaaaaacgcttccaactgcctcccagcacacaaccaagggagaaaactattctgtcaaagagacggtgccaaaaggcaaaaacaaaggtaaggatgatcgctggggaaagaagctgaaaaggaaaagctcagaactctagctggaaatttggctcacatccctagtatgttactgcatagtctggctttgttcaatgggtcgcttttaaatattaaagctagatgtaagcaaggtttgcaacaaagtccataagaaactcagcttttctcaaaggcaagaagagagcaggatttttgactggctctttattcaatagtgctgcttattaaattaccactgctacaatgtttaaagccaattacctgagcacatcataaggattctcttaccggttgtcccagttaagtaatgttgattgatcaactccttgacaggagctgatggcaaagaaggtagctgtgattggagctggggtcagtggcctaatttctctgaagtgctgtgtggatgagggacttgagcccacttgctttgagagaactgaagatattggaggagtgtggaggttcaaagtaagtgagattttcttgggtcttgaacaggttgtgttgttatttcagggtgaatcacagttactgatgggtcatattgagaaatttattaaacaactctgatcagattttatttctatttattgatgtggccataatggaactgaagtcataggctggca

SEQ ID NO: 450 - DNA, 1001 bp, Homo Sapiens
  allele 501: 12-345-410 : deletion  TAA
  misc_binding 481..500: 12-345-410.mis1, potential
  primer_bind 96..113: upstream amplification primer
  primer_bind 601..621: downstream amplification primer, complement
actcctaagctgctaggaatgctaaaatgctaggtctccttctcagatcccaatgggcagccctgccaagctagcttgactagatgggttgtctcataatcctgagacaacgcagacgctctgcatcccttatcaccacctttcaacctactggggctctgtgattgatttatttaacgacttcagagcagggtgaaacactgctctgcatgtctcactatatatctcactatttctagatcctccatttttaaaaggaattgggattcactcattcatcaagtattgttcagcatctactctagagcagatacagtggtgagggaaaaaaagtctcagccttcatggaacctataaatctagtgggaagaagagagactaaacaagtgcaccaacaaataattacaatatgctacttgctatgagggtacatagagaacatgaaagaccaagttagaatacacagctgagacattaaaaatgaatataaatcctcttaataaccactactgcatgcacaaatgaggccttatacagtatgtcgtattggggtaaaaaaaaaatcttttaaattaaaaaaacgcaaagttggtaggagggcattcaccaaacattaactgaagtcatctctggcttttaacaccagagtaaagtgcattcacttttttattttaaattaaataccgaagctgggtgcggtggctcatgcctgtaatcccagcacttgggaggctgaggtgggcagatcacttgaggtcaggagttcgagaccagcctggtcaacatggtgaaaccccatctctactaaaaaaaaaaatacaaaaattagccgggtatggtggtgggcgcctgtaatcccagctacttgagagggtgaggcaggaaaatcacttgagctcaggaggcggaggttgcagtgagccaagatcatgccactgcactccagcctgggcaacagagcgagagactgtctcaaaaaaaaaaaaattgaatacctaaaa

SEQ ID NO: 451 - DNA, 1001 bp, Homo Sapiens
  allele 501: 10-358-353 : deletion  AGCC
  misc_binding 481..500: 10-358-353.mis1, potential
  primer_bind 149..167: upstream amplification primer
  primer_bind 577..596: downstream amplification primer, complement
actggatgtatgtgttctcattgcctgcctgcaacctagaattcctgcccaggaggagttcttcaaacgctatgaaagatgttcccaccccctgccatgcagctacactaaaaggacatattgatttctctccagaattgtgtttatgctgaccactaaatatcaacttattaaaaaaaaaacttacgtggttttaatttttttttcgctcccccctcgcccacaggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagccagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttg

SEQ ID NO: 452 - DNA, 1001 bp, Homo Sapiens
  allele 501: 10-360-190 : insertion T
  misc_binding 481..500: 10-360-190.mis1, potential
  primer_bind 312..329: upstream amplification primer
  primer_bind 713..731: downstream amplification primer, complement
gtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataatta

SEQ ID NO: 453 - DNA, 1001 bp, Homo Sapiens
  allele 501: 10-365-374 : deletion  A
  misc_binding 481..500: 10-365-374.mis1, potential
  primer_bind 128..145: upstream amplification primer
  primer_bind 530..548: downstream amplification primer, complement
tcaaattcttcttttacacgatgactcttaggtgaccaatttatgacgtttggttgtctgttttagtaccttaacaagaaatatccgacataggagaggagaaaaggttgtcatcaatgtaccaagtaagtctactgagaggtggtggggtgggagagagacatgttgtattgttgtttaatcctggattctaaaccatttttatttttgtatttttataatacagtatttaaggacaagaatacaccatctccatttatagaaacatttactgaggatgatgaagcttcaagggcttctaagccggatcatatttacatggatgccatgggatttggaatgggcaattgctgtctccaggtatagtttcaaatatacagagaggcaaagtgttccatccatttctgttttttaacttctttatatatgcatgtttcctgttccaaaaatcacattttaatgaggttgaaatggtagctggtatgcctttctgaaaaacaatgaagttatattagtaaattcattggaagctgtctatgactaatagttctacagactctgttgttcaccacaaaggtatatacggtatatatacctttataactgtaatttcagttaacttaaaatgcaatatattctgtcattgtttcccttctctttttatatgcctagtttttactgccatctcgtgacaggctagtgaggtggtttaaatattgttcaaaactctgaaaatgagctctgatggaagtattccaatgattttgtgatccaagggatttgtgcaaagctgtctagcggtacaaaaagaataaatatttagcagcttgtgtttgtcttgcccctgagtaaagtatacaggagcctgtctctgtttacccatttaaaaattttcctggatctgtttaaatgatggtgcccctggcagtgagtgtgtccaagctcacttaggaccagagtggaagagcatggaacccatcaggtggccacacacaagcctg

SEQ ID NO: 454 - DNA, 1001 bp, Homo Sapiens
  allele 501: 10-367-58 : insertion GTGGAG
  misc_binding 481..500: 10-367-58.mis1, potential
  primer_bind 444..461: upstream amplification primer
  primer_bind 855..874: downstream amplification primer, complement
ttccttctctgacttcactgcttggggagcatgctaatgattccttggtgttaataactttgcaattcttaaacaggtgacattccaagcctgcagtatatctgaggccagatacctttatgatcagttggctactatctgtccaattgttgtaagtagaaattacctcttattttaaatactacttcgtatgaaataagatagcatgtgcagaatttactgacagtgtgctatttaagtccagttaagacctcagtcagagatggactaatataaatagtatgtaggtttaggtataatgaactgagagtctacactgtagaagtttactcttgctagtacaacattgatttgttaaatgtgaagtttgaatgtggccattttccctcccccatacttcatgtcctcacattagagagaggatgatttaagtgaatcaaacccaaggaactggattcttcctggtatatttcactgtaagataggcacaggtacatgtgctctgtatgggttgcataaacatgctttttgatcagaaatataactgcatggagctttttttagcatgtaagtgacactttgaatttgcaggagctgacttttgtttgtttttagatggctttgagtgctgcatctcccttttaccgaggctatgtgtcagacattgattgtcgctggggagtgatttctgcatctgtagatgatagaactcgggaggagcgaggactggaggtgggaattgtttttccttaatagcccttttaagtcaagcaggtaaaatggatcttttgtaactacttgcaatttcaggatgtctccctgcaatttttatctgaaatggggaaaaagatttggtctaggtggggagttaatttttatcgtatgttgatgtctgtatttgttttagcttcatttaaaattagtagtccgatttttctatattttggaagtgctgatggctgtttttaccaaaaggctttttggtgccacatgagtgtttt

SEQ ID NO: 455 - DNA, 1001 bp, Homo Sapiens
  allele 501: 12-468-424 : insertion T
  misc_binding 481..500: 12-468-424.mis1, potential
  primer_bind 76..95: upstream amplification primer
  primer_bind 583..603: downstream amplification primer, complement
  misc_feature 13,23,255,639,967,971: n=a, g, c or t
gtataagtgctgnttaagagtanttgattgccttttcttggtttaatattaaaccagggtgttctgccaaagaccgcatagtttctctgatatggttccaaagggatattctttccactgaaacactgtatgtataccagtaaatgcttcctaatggtagatgataaatatttttgttgcttgtagatagaatttttccatctagtgtaagcttaggattgttttctttttcccagtgacatgtacagtttcacntactccacttaaaaaaaatcgttagctcagataaagtgtgtggcacatgaaatgaattttgccaattcaccaccgaaatccctgctttatatctcttcagtggaacactaaaccaacttctttcccaagtacactgatttgatctttacaaattatatgaatgtattaaattatcacatgtgccctgaaactgtgtacatctattatgtatcattagagagatggaaaaaaaaaaaagaaactgcttagtaaagtagaaaaaatagttttaaagtaattttgtaaggctaatggaagacttactgtataaaacaaaaaggattttaaccacattcaaattattgactgttttggggcttttcaggaatcacttaaaaagcaccnaagttcacagccaggcacggtggctcatgcctgtaatcccagcactttgggaggctgaggtgggcagatcacttgaggtcaggagtttgagacaagcctggtcatcatggcaaaatctcatctctactaaaaatacaaaaattagacctggtggcatgtgcctgtaatcccagctactgaggagtctgaggcatgagaaacgcttgaacctgggaggcggaggttgcagtgagccaagatcgtgccactgcattccagcctggggaacagagcaagtctttgtctcaaaaaaaaaaaaaaaaaaagcactaagttcatgacaggttanggtnagcccctcccacccccccccaaagtcatgt

SEQ ID NO: 456 - DNA, 1001 bp, Homo Sapiens
  allele 501: 12-481-293 : insertion T
  misc_binding 481..500: 12-481-293.mis1, potential
  primer_bind 774..793: upstream amplification primer, complement
  primer_bind 333..353: downstream amplification primer
tacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaacctttgagtgtgtgtgagttccacagctaaacaaatagtagaagagtttggtttttgtaattaacccaaataccatgaaattattttttcatcattgcgacctcagatgtttctagaaagaagcatagtgatgaagacaaacagatgccgtatctcccctagtagctatcaaccccggtgggg

SEQ ID NO: 457 - DNA, 1001 bp, Homo Sapiens
  allele 501: 12-499-86 : deletion  CCC
  misc_binding 481..500: 12-499-86.mis1, potential
  primer_bind 567..586: upstream amplification primer, complement
  primer_bind 136..156: downstream amplification primer
  misc_feature 77,302,451,665: n=a, g, c or t
aaacttactgcaacctttgctttccagccttccacacacacacaagtctccatggaatcacagggcagttgcaactncccctttcaacaggaaaactgcaacagcctcccttctacccaaaaggcatcacgtcatttaaaagaaggatgaggcagggcagtcagtaataacaatggcaaccacaataggtgtcactccattttgatgttaggaaactcaacagagaaaatcagagaggttgaatgagttgctcaaggtcacagacctaagaaaaccatgctcaggatttgaaccaaggactngcctctctccaaacacacctatgccatctcccataaaaggactggatttttttctgtcccatggctgtttttacctcttgctgagcctatcagctgaggtacgtagggtaaggtgtggggaagcacaaactcctccatgtgcaatgggnttgaaacacctattccacattactgctgttgttgcagcagggataaaggcccgggtcgtgacctaccaaaaggcccctgaatttatttttcagcttttagcttatatttttgtttctattgtaccatttgatgcatgcacttaagtgcctttaaaaaggaaactccaaacagctgagaaagaaacgttataaaattgatgacatcttttttttnttttttttttttttttttttgagacagagtcttgctctgtcgcccaggctggagtgcagtggcatggtcttgggccactgcaatctccctctcctggcctcaagcaattctcctgcctcagcctcctgagtagctgggactacagccacctgccaccacacccagctaagttttgtatttttagtagagacggggtttcaccatgttggccaggctggtctcaaactcctgaactcaggtaatctgcccgcctcagcctcccaaagtgctgggattacaggcatgagccaccgcacccggcttgatgacatcttttatgaaatcctttttatgttt

SEQ ID NO: 458 - DNA, 1001 bp, Homo Sapiens
  allele 501: 12-500-217 : insertion CAATA
  misc_binding 481..500: 12-500-217.mis1, potential
  primer_bind 286..306: upstream amplification primer
  primer_bind 714..734: downstream amplification primer, complement
agatcccatctcttgaaaaaaaaaagcaactggaaagaattactattttttaaaaaatacttttaaaccttttttagagacagggtctcactatgttgctcaggctggtctcgaactcctgggctgaaatgatcgtcctcctgctgcctcagccttccaggtagctggaattacagacacaaaccaccatgctcagctttggaaagagttcttaaaggaattctaattagtggcctcagacaaattctagagaggttcagtcacatccataaaacaagtattatagattgtgcttatttaatggtgagtattctcaccagtagagcagatgttgaatatccaaggtagtgatttaaaagaccaaatgaagattaatcccagcaggatggtgaagaaatggaaattatggaaatcctgaagcatggaaagctctggaaaattcaatgtttgtgtaataatttagaagaggagaatagtttatataggaaagatatacaataatcaaagaaataatagaatttttccttaataagtcttccttaaggatgagacaaatatttaactcaaatgtaggcatttattaatctcaaagagaaaattaactgtccggacaggagaaaaaattaggagacatgaaaaggggggaaaatcaactgatattacttttcatttgcaacattaaatgctagatggaaagaagttttcagaatctcgagaggtaaagaattaacaaccacagaattatcttctcagccaaattattctttaaatttcaggtgattctaacaaaactgaatggatcaagttagggctaaaagtatgccagaagtcttatctagtgtcttggtttgtttgggctgctgtaacaaaaataccttacagtgggtggcttataaacaacaggaatgtattgctcacagttctggaggctgggaagttcacgatcaagtcaccggcagtttcggtgtgtggtgagagcttttgctctctggttcatacat

SEQ ID NO: 459 - DNA, 1001 bp, Homo Sapiens
  allele 501: 12-511-101 : deletion  A
  misc_binding 481..500: 12-511-101.mis1, potential
  primer_bind 585..602: upstream amplification primer, complement
  primer_bind 152..172: downstream amplification primer
  misc_feature 129,588,664: n=a, g, c or t
ggcttgtgtagttttgccctgcacatgtgcagccctgccctcagccaaggatctgtagggaactcccacttagacttctaggaactcatctttgcagctccctccttactggtaccatgccctgcaaanttccaaactttttgcatccctgaacttcagtctctgcctcttcagctcagggagactgctgtgctctgtttgggctccacttcatggcctctgttgttcaaaaagttgcccccaaacctggggcaaatgtgctgctcacttcataggcttcctttctctgaaggagcacagttctatgctgccttgcttccaacgtccgaaaatagctgtcatttattttgtcatttaaaaaccttgaattacagtaagggaaagcatattcataaatgaaatgatgtaaagactttaagtctacctaacatctagtttttttcttttttgctaattggactattcctcttttcattcatgtcctttaagtttgtttatggaaaaaaattatgacgaccacactcttctgtggttataggaactttcacacccattacaacattatgcatttatattctgacgaccttngatgggacacacaaaacctgattcttgcaactttgccatgaactttgtgatttccagagactggtaaccacttagnccccacaaacttctaattctctacacagattatctctctttccttgactcttatggtttgtaaataaatgtcttttacacacaactctgaagcgcgtcagattttatggtaccccatagggctataatgcctatagaaatgggaccaaattgaaattttggaaatctctcttggctttgtagactagttggtcgtaacttcccaagtcacacttctgatacacctgtgagggattactgctttgtgccacactagatgacctgcaaggttttctaaccatagataaagccagtctgtgattctcatggacaaattttatgtgtttgttggaaccagg

SEQ ID NO: 460 - DNA, 1001 bp, Homo Sapiens
  allele 501: 12-586-443 : deletion  C
  misc_binding 481..500: 12-586-443.mis1, potential
  primer_bind 59..78: upstream amplification primer
  primer_bind 523..543: downstream amplification primer, complement
ttgacattttatgttcagcttgcacttctctttctcttctttagtgcctgcaacttctcacccacactttcaacagagaattcagccaggtgcacggcagcgtcagtgactgtaaggtgagcacattgactgtaatttttagccagtatgttgataactgatttctccacagcagcccagattacctattcctggtttttgctgcttttaagcaacttgtcatgggcatagcattgtatttgaaaatttatgacatactgctctggtattcattctaatttttcagagtccgaacactgacttctgaagataaaagtactcctttgtgtctcttagagtgattatcagatgggaaacattttggctttttcatgactcctttggaggagaatattctatggggaggtggtatgttattctttgccagggtacaaggaaaccctgaggttcctggtggcataaagttttattgacttcaacaaagagtgaagtaaacacttcagagaatttctgtgttattcactcaattctagtcagcttgaccttaaaccctcccggctcattcctgccttggggtctttgcacacctactatttctttgcctggaattgcctttctccaggtattgccatggttggctcccttacctctttcatttttctactccattatcacctcctgtgagtcgactctgttaacacctgataataaatctgacagctgtctgaaactttctacctacccctctttcctgctttattttttgctatagcactaattactacctgatgctttttaaagtgtttgttgagtggtttattgtctgtcttaagctccagggaggcagatcctctgccatattattagaacaatgcctagtacatggaaggtgcaccactgtaataccacttatattaattcaggggctgggtgtggtggtgcatacctgtaatcccagcactttgggaggccaagatgaggggatcgcttgaggccaatag

SEQ ID NO: 461 - DNA, 1001 bp, Homo Sapiens
  allele 501: 12-593-287 : insertion TAAAT
  misc_binding 481..500: 12-593-287.mis1, potential
  primer_bind 771..788: upstream amplification primer, complement
  primer_bind 251..271: downstream amplification primer
  misc_feature 135,300,327,765,797: n=a, g, c or t
ttatctttatgttgaccagtttgttccactttttgaagtaacttcattgaactttctgctaacgtatcctttccatattcccctctctcatccctgttctccttcagtctgctaggtcaaagtataaggattctncaaaaatgcagagtaattatgaaaattctgtttaaaaagcttcagaatagaatgtttatatagcattgatttggagctaagggctatattctggtaacataacaaggtgctatctagtgaatgtgtgattgtgtagtcatggagctgatgtccctgccatagaanttacagaattatctaaaaagggaaatnctataataatggccttcaatgctcccacacttggactagccattgccataggcagaaaggcaatctcatctttactgtgtgtgcaaacagtactttaatgtaatgtgtgcttaatataagctttctttaaaaaaaaaaaaggtggctcctgtttttgaatagctatttttaagatagatatagttaggaatctaaatgtgttctatatagttaatatccattatgaggtggctctgaaaaatcaacctagtataagttggatggctttgcttttctgcttctgttataacccatttttctagaaaagcttccacttctacttaaagataagaggcaaatcattttcctgttcccttatgcacatagatgttcacttaccaaatatttatagagtggcccagccctctgcagacagtggtgagcaaaaccagacatggnttcctgccctcatagacttatagtctgatggnatgacacagacataaattaaataattgcacaaataaatgtaaattatagcagtgatgaaatagttgtgtgtgttgtcggagatcacataacgttgggggacctgttatgagaaagtggtgtttgaaataagacctgaagatgtgaaatcaaaggcgtgaggctgggtgtggtagctcacgcctgtaatcccagcactttgggag

SEQ ID NO: 462 - DNA, 1001 bp, Homo Sapiens
  allele 501: 12-795-383 : insertion CA
  misc_binding 481..500: 12-795-383.mis1, potential
  primer_bind 119..136: upstream amplification primer
  primer_bind 679..696: downstream amplification primer, complement
  misc_feature 408,416..417: n=a, g, c or t
ttttaacatcatccctgtttgactgcttctttttctacattctcatcttctaacttttttctagggctgctctttttagtaaagctaaacaaaacctggcgtcctacagccttactaacctttgttaatccgcctgctcgtcacatctttgtatggcatctgtgctcactcatgggggaaagagattctggaagaagcaacagcaataaccaaggcaaatgtggggaagtgtctgcatgggttgttagcatgatgtgtggggcctaggttttacttcattttcttcgaatagtgaggtcgttaagtcacgccatttgaataattttgtatgaccatagggtgacatactcatccctgttgtcaattctcctaagaaatttggtggcaaatttcatcacttaagccagnaaagtggnnaaatttggattagggatgccaaataagcaaatctttatattgatagaaatgtacataggcgtatgtcttaatagacttccacattattgaggggttttttttggttttgttttgttttttagtttttttggtcttatttttaaatttggttaaggcttttttgcttgctttttcttcgatttaattttccttttttacattttaattttggttattttggggccattttttgattttgtttttccaaaggacgcggattctgatagcggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagataccccaaagaaggcgcttgagtaaagattccaagtgggtcacaatctcagatcttaaaattcaggctgtcaaagagatttgctatgaggttgctctcaatgacttcaggcacagtcggcaggagattgaagccctggccattgtcaagatgaaggagctttg

SEQ ID NO: 463 - DNA, 1001 bp, Homo Sapiens
  allele 501: 10-494-332 : insertion ATAAAA
  misc_binding 481..500: 10-494-332.mis1, potential
  primer_bind 170..188: upstream amplification primer
  primer_bind 574..591: downstream amplification primer, complement
tttttcatatagtggtttgccacatatagttttcttttgaaaagtgtaacaactttttaaatacttgaacttttcattgattatcttatttgtctaagctactattttgaaaaatcatgatttccttatatacctaattatgaaattaaggaaatgaaatatgagtattctatttacatcagtctgagtagttcttgttacttaacatcccttgttcttctcattgttaatctctttagatttctaacattctatgacttttgagttccactcatggaataagatattttcttcactgtaacaggttctgtggagatttgatgggaataaaccagatactttaggactcaatactcggctgtacaagtggataccccagaatgatcttcttggtaagtctctgaagaacaaatactgaatatattagtaacagattattaaagtgttaatagttatcatgaaacaagcttactgaacatttgttatggaaaaacttaaaatgaaacttctttatatttattttccagtcccgggggaaaagaataaatgataattgttggcattttatgatatgcacccacattctttacaatcagagtcagagtatctttatttcaggtgttattacctcccacagaatttttctggcacttcctgggttgtcttcctttctcatatttctacaactttacacctgttctttcctcctctgtagggttatttcaaatgtcactaaaagtaacagctcttctgctatcaccagggatgctgcattttctgtaggattaaatccctaatcttaatcaaaaagtgatgacacatttcataatgaaatgtgacctgtctttcctcaattctagcaccaccaccacctcactgcctgctgccttgcacaccctacatatcacactccgtgactgtacttaagagaacacattctggctgggcacggtggctcacgcctgcaatcctagcactttgggaggctgatgcaggtggat

SEQ ID NO: 464 - DNA, 1001 bp, Homo Sapiens
  allele 501: 10-494-380 : deletion  GATAAT
  misc_binding 481..500: 10-494-380.mis1, potential
  primer_bind 122..140: upstream amplification primer
  primer_bind 526..543: downstream amplification primer, complement
acaactttttaaatacttgaacttttcattgattatcttatttgtctaagctactattttgaaaaatcatgatttccttatatacctaattatgaaattaaggaaatgaaatatgagtattctatttacatcagtctgagtagttcttgttacttaacatcccttgttcttctcattgttaatctctttagatttctaacattctatgacttttgagttccactcatggaataagatattttcttcactgtaacaggttctgtggagatttgatgggaataaaccagatactttaggactcaatactcggctgtacaagtggataccccagaatgatcttcttggtaagtctctgaagaacaaatactgaatatattagtaacagattattaaagtgttaatagttatcatgaaacaagcttactgaacatttgttatggaaaaacttaaaatgaaacttctttatatttattttccagtcccgggggaaaagaataaatgataattgttggcattttatgatatgcacccacattctttacaatcagagtcagagtatctttatttcaggtgttattacctcccacagaatttttctggcacttcctgggttgtcttcctttctcatatttctacaactttacacctgttctttcctcctctgtagggttatttcaaatgtcactaaaagtaacagctcttctgctatcaccagggatgctgcattttctgtaggattaaatccctaatcttaatcaaaaagtgatgacacatttcataatgaaatgtgacctgtctttcctcaattctagcaccaccaccacctcactgcctgctgccttgcacaccctacatatcacactccgtgactgtacttaagagaacacattctggctgggcacggtggctcacgcctgcaatcctagcactttgggaggctgatgcaggtggattgactgagctcaggagttcaagaccatcctgggcaacatggtgaaact

SEQ ID NO: 465 - DNA, 929 bp, Homo Sapiens
  allele 429: 12-659-251 : deletion  TT
  misc_binding 409..428: 12-659-251.mis1, potential
  primer_bind 179..198: upstream amplification primer
  primer_bind 611..631: downstream amplification primer, complement
  misc_feature 80,605: n=a, g, c or t
ttgattttatattaaatcagattaaataaaatcatgatgttttatacaaagtgacttagatattgagataataaatgaancattcaaatatttaagtaatcattaggcagacataattccagtgtaaagatgagtaaaaaattactaatggtccccaccctttttattaatgtatttactacattcactttcaacttccaaataatgttaagcttttcatttctaaagcaatgaaaagggagtgagtttacttatattcacttgtttcataagttatattcccatatctgatgatttacaaagaaagcaaatctatcaatcatctatgtctgagaaatacattaatctgcttaaaaggcacatataatttgtttccgattacaaattattaagcactttttccaagaaaaaaattcaagtgactttttttcccatatgtgcagaataatatcgcatgtgctacaattggaaattatttaaaggtggaaaagactgattggcagttctttaataataggtctgtttaaaatatcccaaatttgtggtgatgctaaatttcattctgctggctcttaactcttcagtggcacaatccaaagcgttgncagcagtggtttatatggtctgctatagctaagccatgtagtacatgcctagtaccaacatgtggtactgattttggaattaccaagcaatcttcataaactagtgtataatctacaagtttttaacgtgtacttgctatctgagttttaaaagtaactacacatttgcatcaaaaaattagtataggtgattacaagaatgttatacaggatataaaactaaaaactgctttataaatattcaaatatcaaagttgctgcatcagctcagagacgctgaagctgtgctggaggcagcagagttaatggcggcaagtccctgtg

SEQ ID NO: 466 - DNA, 987 bp, Homo Sapiens
  allele 501: 12-912-419 : deletion  A
  misc_binding 481..500: 12-912-419.mis1, potential
  primer_bind 83..103: upstream amplification primer
  primer_bind 554..574: downstream amplification primer, complement
  misc_feature 86: n=a, g, c or t
aagtttacttattatcctgtgaagtatattttcatacctgaattttacctagcttcagccttccattaacgttgcattcattcttnaacatttgtaaaccaccatattttctagaaattggtgactatattctaaaatcattgtagtcacgaaatcatatgaatacctgcttggcctctccggatagggtcaagtttctcacataagcaaaatttacttatttggcatatacaatgtgaacataatcttaaaacctgactttggcttttggtgttattaataaggttcttaatccaatttttgttttttttttacagaagtgatacagctatactgtaatcctagcattcctgagttttgtatatagcttggaaataatatttattgtcaaatatttttaaatacttcactttcttctaatatatttattaaccttagcatctttttttgcattttttccctgtgaagtgtcattcactctatcaattactatcagaaaaatctgttatcatcttgcctatttatgcaaagcaaatgattctccaactgttgactctaatccttcctctcaaataggttctgctaaataaatgaccctgagtctctgagacatttgttgtatcaaagcacaacaacattaacagtaaaacaaaaaatattgtgaaatatgaaatatctgatcctttctccctctctcaaaaattctgtctgccaggtgtggtggctcacgcctgtaatcccagcactttgggatgacaagatgtttggatcacctgaggtcaggagtttgagaccagactggacaatgcggtaaaactccgtccctgctaaaaatacaaaaattaaccaggcatggtagcacatgcctgcaatcccagctactcaggagactaaggcacaagaattgcatgaaccaagaaggcagaagttgcagtgagctgagatcgcagcactgcactctggcctgggcaacagagcaagactccg

SEQ ID NO: 467 - DNA, 806 bp, Homo Sapiens
  allele 306: 12-914-28 : deletion  T
  misc_binding 286..305: 12-914-28.mis1, potential
  primer_bind 279..298: upstream amplification primer
  primer_bind 773..793: downstream amplification primer, complement
  misc_feature 536: n=a, g, c or t
aactcctattatatggaggtagttttcttaataatgtttgatactttccatatgcctacttcactaattttaattatttctctttttttgctcttctgattgggtaattacatatgttttatctttaggattgctgattccttactctgtttgaccaagtctgctgttgaagttttctactgagtttttcaattcacttcacatattttttattaattggatttctttttatttttaaaacatttccacttctttgcaaaatttatcatcattttcctggattattctctaaagtgtgttttttttcaactctctattcatatgtgctgtgatttctgaacttttaaaataggtgtgcactgaatttcttgtcaaaaattttatggagcatctgaaccttaattctgcactgtaacttaaaactagacttgcagtgatttctaggtctgtgagatacttaagcaataactggagcttaatctcaaatgttatacttgtttgcaggtcatagaaaagctccgtatgagtaactgggnattataaaaatacctgccaaagattcaggccttcctttggattttggcccctgcagtgttatggaactggtcagactcctcagcgtggcattcctgctaataggaacaccaagcagttgctgagatgtgtgtgcctgtcactgtgattagtacttccactcttgtttccaattcaccccaggtcattcaactctatagccactcctaatgcctctcctgaggtaggacaaaagtgggcttcccaaaccaaaaagattcacagatccatga

SEQ ID NO: 468 - DNA, 1001 bp, Homo Sapiens
  allele 501: 12-624-307 : deletion  T
  misc_binding 481..500: 12-624-307.mis1, potential
  primer_bind 788..808: upstream amplification primer, complement
  primer_bind 340..360: downstream amplification primer
  misc_feature 132,690,865: n=a, g, c or t
tgagatagcatgttcttgggttttaatataatattatcaatccattagtgccatttagaaaacttaaattgaccagcaatccggtgctctctatctgataaatttacagcctgtttttggacacctacttgnatattttaaatatttattaataaatatattagaatgttaattaaaatttttaattatggctaaaattttagtaaacaaatttttaaaattttaatgtcttatgtcaacattttatgaattctacagtagtttagtgatttcttctaatttttaaggttatatttgcagtaattttgagatgtgattacaaatgcattggcaatcctctcatcaagtcatatacccttcctgtgaaatttagcaaattttgtggctgtctcaaaaaagagaatatagtggaagtgaggagcttaacttccaaagctcaaaaaaattgttaatacattttctctgtctgtccttctgtccttttctctgtgtttctgtcattcttttttcctttttctctgtctctccactcgctttggagccctgtgctatatccacagtccccaggagaaatataccatttggtgtagaaatacatatgtatgcctaataagtcacaattggcccagcactgcagtagcttgagacttttaatactaatcaccagatatgtgagtgattaaccttcangatgattagcccaagctaccttaggacagtaaccaactgagaaatgctgtgccataaacacctaattgagcctggccaacaacctagaattaaaacagatgatgataaaatgttgctgttctaagcaccttcatttcagagcagttggttaagcagtgatagacaaccagaaaanatatttttacatatttgagttatactcctgtaataatattaaaattaatatatacctacaaaaaaagtgaatctatattacattttgtaactacctgtaacccagaaagagtagtcagcataggatggtgggtaag

SEQ ID NO: 469 - DNA, 1000 bp, Homo Sapiens
  allele 501: 10-290-326 : polymorphic base A or G
  misc_binding 481..500: 10-290-326.mis1, potential
  misc_binding 502..521: 10-290-326.mis2, potential complement
  primer_bind 177..196: upstream amplification primer
  primer_bind 576..595: downstream amplification primer, complement
  misc_binding 489..513: 10-290-326 potential probe
atgctttgaatgttcaaagaaaccaagtgatctctatggctaggcattccctttaacttatgtgatgagctaaaattttcaaattgcaaaaatatagaagttctggacagtgttaacgataggacagcctacctcaggactctcagcttccttattacagtccagtttgtcacttttctccctcatgtccactctgcaggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaatggctttgtagaaacacacactttagagaatacatttcctgtttaagaactgaaatttgcttgrggtaggtacatccatatcatcagtggaagtgtgttgtgccctagttttagaaatgcatgctgaagtcatgaccggttgtgtagggacacagcagcctgacccgtgtgctggccgttccgaggactactgacatatcctgccactctgactgcttctctcttgatggaaagtttcagacagaagctgataaagcagctgagccctttcattggttataggaaaacaacagataggaaggcatgtgggggacatcaggcaaacacatagagtagccagagaagggagtcatcaactgatagcacaaaacaaaacaggttatagaaggctgggcgtggtggctcatgcctgtaatcccagcactttgagaagccgaggcgggcagatcacaaggtcaggagatcgagaccatcctggctaacacagtgaaaccctgtctctactaaagatacaaaaaattagccgggcatggtggcgggtgcctgtagtcctagctactcgg

SEQ ID NO: 470 - DNA, 1000 bp, Homo Sapiens
  allele 501: 10-290-37 : polymorphic base C or T
  misc_binding 481..500: 10-290-37.mis1, potential
  misc_binding 502..521: 10-290-37.mis2, potential complement
  primer_bind 465..484: upstream amplification primer
  primer_bind 864..883: downstream amplification primer, complement
  misc_binding 489..513: 10-290-37 potential probe
aaaaaacggtaaggagaacccagtaattttgtatttatgcaaaaagtagcaggataaggtctgggtcagtttccttctcctgagagatattaacagcactgtgagttgtggtggcaaaagtaatccatactgtctgaggtcaagtcttgccagttcatacacaattaggcatgagatgggaaaatgcaagtataaaactgtgcactgaatgtggactctagttccttgcaaaaattttgcattgtctccagaaagttaccgaggaaataatcctgcctagccttgataatgctttgaatgttcaaagaaaccaagtgatctctatggctaggcattccctttaacttatgtgatgagctaaaattttcaaattgcaaaaatatagaagttctggacagtgttaacgataggacagcctacctcaggactctcagcttccttattacagtccagtttgtcacttttctccctcatgtccactctgcaggatcaccggtttcygactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaatggctttgtagaaacacacactttagagaatacatttcctgtttaagaactgaaatttgcttggggtaggtacatccatatcatcagtggaagtgtgttgtgccctagttttagaaatgcatgctgaagtcatgaccggttgtgtagggacacagcagcctgacccgtgtgctggccgttccgaggactactgacatatcctgccactctgactgcttctctcttgatggaaagtttcagacagaagctgataaagcagctgagccctttcattg

SEQ ID NO: 471 - DNA, 1000 bp, Homo Sapiens
  allele 501: 10-523-232 : polymorphic base C or T
  misc_binding 481..500: 10-523-232.mis1, potential
  misc_binding 502..521: 10-523-232.mis2, potential complement
  primer_bind 270..288: upstream amplification primer
  primer_bind 527..545: downstream amplification primer, complement
  misc_binding 489..513: 10-523-232 potential probe
acttcaggagattttaagggaattatttaaagaccattttgtaatgttctgggtaactcaagtggaaggcaatggatgtgagggaatttttaaaataagaaatctcttgaatatgaattgagtaatctcttaagttctttagataagatatggagtgatctttaggctcaggaggcctgtcttttgggaaagtgctataactcacttctactaccggcaacttaatacgtaagagaatattcttggccctgctctgaggtttaaacaatgttcaaccttgaaagattgattttaaatgtaaaggtcatttaaactcttttgtaagttcttatattttgttaaaataggctgaacatttacctctagatgaaaaatcaatgcttcagtgtatacttttctcataaaataacctatgtctttatttttttctgcagacaaaactgtgtggagttttatcctatattcataattacattgtggatggctgggtggtatttcaaycaaggtaatgttaaaatacagtcaactgtgttctaatgatgactatgatgcttaaacgattaaggagtagatatatggccaggcacggtggctcacacctatattcccagcactttgggaggcccaggtgggtggatcacctgaggtcaggagttcgagaccagcctggccaaaatggtgaaaccctgtctctactaaaaatacaaaaattagctaagtgtggtggcgcatgcctgtaatcccagctacttgggaggctgagacaggagaatcacttgaacccaggaggtggaggctgcagtgagctgagatcgtgccactacactccagtctgggtgacagagactccatctcaaaaaaacaaacaaaaaaaggagcagatatgcaactatatagctaccaatcctggagactaaacaaaataaacagtgtgtgcatcagagtgctatgttgcaggtatatgaactttggcttcattctaatttaattcaataatgaa

SEQ ID NO: 472 - DNA, 1000 bp, Homo Sapiens
  allele 501: 12-449-300 : polymorphic base T or C
  misc_binding 481..500: 12-449-300.mis1, potential
  misc_binding 502..521: 12-449-300.mis2, potential complement
  primer_bind 783..800: upstream amplification primer, complement
  primer_bind 325..345: downstream amplification primer
  misc_binding 489..513: 12-449-300 potential probe
ccaccagagttcataccagcatggaatctgtacacatctttaaatgatacttagatttacttccaaataaagagctctttcatctcataatgcaactgtccattatataaccaaacccatactaactctttctccaaaagaggatccaaagtccctttatccctctttgggccatgattatttgtcttctaacagagtcacattgtctccttgagacgtaaagatgcatttagatgcagggggacggaagaaaggaaaagaaaaaatagtttatatgtatatacatttgtatcaaaataagaaataaatactcataattattacaattttcctctgaaagtagtcacatggttatacctggtatttatttattttttattattattattattatttgagacagggtctcaccctgtcacacaggctggagtgcagtggtgcaattatggctcactgctacctctgccacctgggctcaagccatcctctcaccttagcctyctgaacagctgggatacatgtgcactaatttttttttttttgaaacaaaaatatttgtgtagaaggcacaaaagctacaatcacagactccactgtgcaaaggcgcaacctgcctcattgatctctagtgtacaccaacccagcttccctttccattcagcctgtgaaaggagatagtgcttgggccatttggtaaaagaaggggatgggagatgatcaaaaccccaagtaaggttcatccaatatggtgtctaagcagcaaatgactaattgctgaagaaggagactagacagaggattagaggcagccatggggccagtgcagctgtggagagctctgagcaaagaaacaaggttggcaggtgaggaggcctaggatagaggccagaaggccaagcctggggctgcatgtgcactaatttttgtatttttttgcttttttgatagagatgagatttcatcatgttgcacaggtgggtcttgaagtcctgggctcaag

SEQ ID NO: 473 - DNA, 432 bp, Homo Sapiens
  allele 212: 10-186-212 : polymorphic base G or C
  misc_binding 192..211: 10-186-212.mis1, potential
  misc_binding 213..232: 10-186-212.mis2, potential complement
  primer_bind 1..20: upstream amplification primer
  primer_bind 413..432: downstream amplification primer, complement
  misc_binding 200..224: 10-186-212 potential probe
agtatgacgataggcagatgttgtcttgcaaaacgagcaaacaggcatatgaaatcagatacctagctgccaaactatatgtgaggcatttccgaagaatttaacgacctcgatagagcgcagtcaagtttggtgaacagaatatgtctctgaactagaggagtcctcacacaaggagtagggtcagaccccgcagtggaggaggagggagsagtagaaacagtccagctcgccgcccaagtaacctgggtcctgaatcggcccgccttggccagtgctccagaagcgcggagaggaacgggctggggcccaaaaaagaggggggagcctgaacgtccgggggaagtttcggaggcggcggaacccacggatggaaccctgtctttggggaaaaggaccacacctgtcagcagagtccgtcagacgtgagaa

SEQ ID NO: 474 - DNA, 1000 bp, Homo Sapiens
  allele 501: 10-286-289 : polymorphic base G or C
  misc_binding 481..500: 10-286-289.mis1, potential
  misc_binding 502..521: 10-286-289.mis2, potential complement
  primer_bind 213..231: upstream amplification primer
  primer_bind 613..631: downstream amplification primer, complement
  misc_binding 489..513: 10-286-289 potential probe
aaaaaaaaaagtatgattattatcagagtctctaggtgacagtgagaggcagcctggtgcaggggatagggcacagttgtaatctgctagactgggttcaaatcctaaatcggccattcagagcgtgaatacattagaactggcttaaattagcatttaaaatgtcaacaggattaagtaagtagttccttctcactttttccacaggaggtgagaaaggtctcagcaaggccctaggagggaagggcgtggggatgaaagggatccagagagtctgtgcattggcagagaagatagtgtaactggcactgcggctggagggctggtcccacagtgagctacagccctgcccgctggccgtgggagaggcttaaaacaaacgccggaagcaactcccagccccataaagatctgtgaccggcagccccagacctgcctgccttcctgacttctgttccagagcaaaggtcattcagccgcttgaatcagccttttcccccsacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagtaagaggcatgggaagttcgtgtgtgtgcgcgtgtgtgcgtgtgtgtgtgtgtgtgacaaggcttgcgggagagagagggagggagggagatgggtccggtgttttgtttcctacttgcccttgcaggtagctctgggtcctcagagcacagtcgcctcagggtcacccatgccgcctgctaccctccttcccaggggcaagcagagactgagaacattccagagattagttctcccaactggaacgctgtggggcctcagagctcagcgattctgcatcatctgtgattacgacccacagcccgttcaaacgagcgttagtagcctgctaacctgc

SEQ ID NO: 475 - DNA, 1000 bp, Homo Sapiens
  allele 501: 10-286-345 : polymorphic base A or T
  misc_binding 481..500: 10-286-345.mis1, potential
  misc_binding 502..521: 10-286-345.mis2, potential complement
  primer_bind 158..176: upstream amplification primer
  primer_bind 558..576: downstream amplification primer, complement
  misc_binding 489..513: 10-286-345 potential probe
ggtgcaggggatagggcacagttgtaatctgctagactgggttcaaatcctaaatcggccattcagagcgtgaatacattagaactggcttaaattagcatttaaaatgtcaacaggattaagtaagtagttccttctcactttttccacaggaggtgagaaaggtctcagcaaggccctaggagggaagggcgtggggatgaaagggatccagagagtctgtgcattggcagagaagatagtgtaactggcactgcggctggagggctggtcccacagtgagctacagccctgcccgctggccgtgggagaggcttaaaacaaacgccggaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagwagcgccatttatcttcccgtgcgctctacaaatagttccgtgagaaagatggccgggaactcgatcctgctggctgctgtctctattctctcggcctgtcagcaaagtaagaggcatgggaagttcgtgtgtgtgcgcgtgtgtgcgtgtgtgtgtgtgtgtgacaaggcttgcgggagagagagggagggagggagatgggtccggtgttttgtttcctacttgcccttgcaggtagctctgggtcctcagagcacagtcgcctcagggtcacccatgccgcctgctaccctccttcccaggggcaagcagagactgagaacattccagagattagttctcccaactggaacgctgtggggcctcagagctcagcgattctgcatcatctgtgattacgacccacagcccgttcaaacgagcgttagtagcctgctaacctgcaggaagtggtgtgaatattaattacaagtgttccaaaggaaacgtgcctgcttct

SEQ ID NO: 476 - DNA, 1000 bp, Homo Sapiens
  allele 501: 10-286-375 : polymorphic base A or G
  misc_binding 481..500: 10-286-375.mis1, potential
  misc_binding 502..521: 10-286-375.mis2, potential complement
  primer_bind 128..146: upstream amplification primer
  primer_bind 528..546: downstream amplification primer, complement
  misc_binding 489..513: 10-286-375 potential probe
gctagactgggttcaaatcctaaatcggccattcagagcgtgaatacattagaactggcttaaattagcatttaaaatgtcaacaggattaagtaagtagttccttctcactttttccacaggaggtgagaaaggtctcagcaaggccctaggagggaagggcgtggggatgaaagggatccagagagtctgtgcattggcagagaagatagtgtaactggcactgcggctggagggctggtcccacagtgagctacagccctgcccgctggccgtgggagaggcttaaaacaaacgccggaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacraatagttccgtgagaaagatggccgggaactcgatcctgctggctgctgtctctattctctcggcctgtcagcaaagtaagaggcatgggaagttcgtgtgtgtgcgcgtgtgtgcgtgtgtgtgtgtgtgtgacaaggcttgcgggagagagagggagggagggagatgggtccggtgttttgtttcctacttgcccttgcaggtagctctgggtcctcagagcacagtcgcctcagggtcacccatgccgcctgctaccctccttcccaggggcaagcagagactgagaacattccagagattagttctcccaactggaacgctgtggggcctcagagctcagcgattctgcatcatctgtgattacgacccacagcccgttcaaacgagcgttagtagcctgctaacctgcaggaagtggtgtgaatattaattacaagtgttccaaaggaaacgtgcctgcttctaaacctggttgtgatttcttgaacgttgat

SEQ ID NO: 477 - DNA, 1000 bp, Homo Sapiens
  allele 501: 10-289-201 : polymorphic base C or T
  misc_binding 481..500: 10-289-201.mis1, potential
  misc_binding 502..521: 10-289-201.mis2, potential complement
  primer_bind 307..324: upstream amplification primer
  primer_bind 700..719: downstream amplification primer, complement
  misc_binding 489..513: 10-289-201 potential probe
tgcaacctccacctcctgggttcaaacgattctcctgcctcagcttcctgagtagctgggactgcaggtgcccgccaccatgcccagctaatttttgtatttttagtagagacgaggtttcacaatgttggccaggctggtcttgaactcctgacctcaagtgattcaccccccctcggcctctcaaagtgttgggaatacaggcctgagctaccacgtccagcctcattatagatttaagtgggaatttgttgatgttgaatcatgttgaaacatttttcttgagattattggcacatttgtttccttcctatgtggattctctctatattctgaatataagtatcttgtccaatatatgttttgtgaatattttctcagtcgtcgtacaacatcttaagagactgctgttgtattttgtgccttttctttttttttcccacccccctatagtttttgctacttgtctgggtctggtgtacatatatggccgtcacctayacttctggggatattcagaagctgctaaaaaacggtaaggagaacccagtaattttgtatttatgcaaaaagtagcaggataaggtctgggtcagtttccttctcctgagagatattaacagcactgtgagttgtggtggcaaaagtaatccatactgtctgaggtcaagtcttgccagttcatacacaattaggcatgagatgggaaaatgcaagtataaaactgtgcactgaatgtggactctagttccttgcaaaaattttgcattgtctccagaaagttaccgaggaaataatcctgcctagccttgataatgctttgaatgttcaaagaaaccaagtgatctctatggctaggcattccctttaacttatgtgatgagctaaaattttcaaattgcaaaaatatagaagttctggacagtgttaacgataggacagcctacctcaggactctcagcttccttattacagtccagtttgtcacttttctccctca

SEQ ID NO: 478 - DNA, 1000 bp, Homo Sapiens
  allele 501: 10-321-28 : polymorphic base A or G
  misc_binding 481..500: 10-321-28.mis1, potential
  misc_binding 502..521: 10-321-28.mis2, potential complement
  primer_bind 474..491: upstream amplification primer
  primer_bind 890..909: downstream amplification primer, complement
  misc_binding 489..513: 10-321-28 potential probe
tgcacacccccagccccatgtcccctcacttgtccccacggggcagcaccttgcttttgccctttttctcctcctctatttcaaaagaggcccccacccctgacatctctggctggaaaggctgctgctggggtggccccgacccaagatttacctgggaatgggtagcctcactcagaagggtgccctgatgtgggggcacaggtgggtctttggggacccctcctgggtggtgccagggagagaatagcggcttcagcatgcttcggggcagctgtaaaacgagggggtcctgcaaagcgtgcagggtaagtggtgtctggtgggagccccgggtcctagcccaggctcttctgcctccacggctgcagctttggagcgatggtgtattcaccacggacaggcatcatcctcaacaacgagctcctggacttatgcgagcgatgcccccggggttccggcaccaccccctcacctggtgagaacaaagcttcccacccrgggtccacaagggccccccaccaggggagaggagggagggggctgggctggggttgcatgctaacccctggatgggtcactgcacttgccaagacgctgtttgctcagcagtgagtggagacagggtgggtggagctcccggaaggtgctggcccccagttccaggcgagcgttccccatcctccatggtgccctccatcttgatcaacaaagcccaggggtcgaagctagtgattggcggggctggcggggagctcatcatctctgctgtggcccaggtgagtctggggctcctggctcgagtgtctcctctctgggcagcatactgtctgactgtctctggagtggggatgtgagggctgatgtagggtagcagggtgccccctttctccctgaaaccctcatctctcccccaggccatcatgagcaagctgtggcttggctttgacctgagagcggccattgcagcccccatcctgcatgtcaacagcaagggctg

SEQ ID NO: 479 - DNA, 422 bp, Homo Sapiens
  allele 265: 10-98-265 : polymorphic base A or G
  misc_binding 245..264: 10-98-265.mis1, potential
  misc_binding 266..285: 10-98-265.mis2, potential complement
  primer_bind 1..19: upstream amplification primer
  primer_bind 404..422: downstream amplification primer, complement
  misc_binding 253..277: 10-98-265 potential probe
ctgtcttcaggaaactcacaggctagggccagagaaagctaatgctggatacatacatagcagatacttgggaaatgatggtttccttgtttctgtcttccttctttcctcaccttacactacacggttcaggatttgacacagtcaccacagccatctcctggagcctcatgtaccttgtgaccaagcctgagatacagaggaagatccagaaggwgctgggtacatgggggcccccaaccctatagccaggagaagccttgaracccaggttgtttgttcagtctacaaacacctgttatgtgcctgctgtgtgcaagccctgggcacacagtagtgcctgcccttgcctagaagatgtgggaggttagtggggtcgcagacttgtgaatagacagtcttacatagagtgacatggggta

SEQ ID NO: 480 - DNA, 1000 bp, Homo Sapiens
  allele 501: 12-157-115 : polymorphic base C or T
  misc_binding 481..500: 12-157-115.mis1, potential
  misc_binding 502..521: 12-157-115.mis2, potential complement
  primer_bind 387..407: upstream amplification primer
  primer_bind 833..853: downstream amplification primer, complement
  misc_binding 489..513: 12-157-115 potential probe
gggagtgctgccgccatcatggtcaccaaaagccaccaccccctgcttgtgttggacaggcggtcatcaaggcagaaccgactgacaacctggtttctccagtgcgagccttggcgatggaggccctctcgcacctgaggtgagctgggttcccaccctcaccccatcccaaggggtagggaaaagttcaagaccattcctcggtgctccttcaggggttgtgcctcctttttcctctcctccctctgtagcaggggtctcacttggcggctccccagggcaatgggccagcctagatgatgggggtcggcctcagccactcttttctataattctcagccagatttcaagttgggtgcttctccttggatttatggcacatgggtgggctgctcttccattgattggggatattttgagcaaaataacagtgataacactgaagagcattgcaagcatccttcaagatgagtcaggctcagtgagtgagttgaagggctyagtcaactatttgttgataccactggtacaaaatgatctaaagcccaagacttaccttcctggagatgccaatccattggtggggagggggaaaggggaagaagttatggatttataaaattagtatttaaagagtttgggtcatctctaagaatacctcccctataggggaagattcattacttaggcgcatagcagaactatctgttactttaagctgcatcaaacaggcagattttaaaataaatgtcatgaacatcaactaagcacaatgatatgctgagtactgaagggacacagagatacataagacctagtcccagccttttaaggacttagagataagacagacacatacaaacaggattataggtcaaagctgactaacaggactgtgtttacaggtaaacccacacacacatcagcaaaaaaatatctgagaacaaaaaaaaaggggctactaacaaaagcaactcagtttatacaaaaggagctatca

SEQ ID NO: 481 - DNA, 1000 bp, Homo Sapiens
  allele 501: 12-472-48 : polymorphic base G or T
  misc_binding 481..500: 12-472-48.mis1, potential
  misc_binding 502..521: 12-472-48.mis2, potential complement
  primer_bind 454..472: upstream amplification primer
  primer_bind 919..939: downstream amplification primer, complement
  misc_binding 489..513: 12-472-48 potential probe
atgaagcgttgttaacttgcccctctctgcccagcaccttccttctctgacttcactgcttggggagcatgctaatgattccttggtgttaataactttgcaattcttaaacaggtgacattccaagcctgcagtatatctgaggccagatacctttatgatcagttggctactatctgtccaattgttgtaagtagaaattacctcttattttaaatactacttcgtatgaaataagatagcatgtgcagaatttactgacagtgtgctatttaagtccagttaagacctcagtcagagatggactaatataaatagtatgtaggtttaggtataatgaactgagagtctacactgtagaagtttactcttgctagtacaacattgatttgttaaatgtgaagtttgaatgtggccattttccctcccccatacttcatgtcctcacattagagagaggatgatttaagtgaatcaaacccaaggaactggattcttcckggtatatttcactgtaagataggcacaggtacatgtgctctgtatgggttgcataaacatgctttttgatcagaaatataactgcatggagctttttttagcatgtaagtgacactttgaatttgcaggagctgacttttgtttgtttttagatggctttgagtgctgcatctcccttttaccgaggctatgtgtcagacattgattgtcgctggggagtgatttctgcatctgtagatgatagaactcgggaggagcgaggactggaggtgggaattgtttttccttaatagcccttttaagtcaagcaggtaaaatggatcttttgtaactacttgcaatttcaggatgtctccctgcaatttttatctgaaatggggaaaaagatttggtctaggtggggagttaatttttatcgtatgttgatgtctgtatttgttttagcttcatttaaaattagtagtccgatttttctatattttggaagtgctgatggctg

SEQ ID NO: 482 - DNA, 1000 bp, Homo Sapiens
  allele 501: 12-477-151 : polymorphic base G or A
  misc_binding 481..500: 12-477-151.mis1, potential
  misc_binding 502..521: 12-477-151.mis2, potential complement
  primer_bind 631..651: upstream amplification primer, complement
  primer_bind 113..133: downstream amplification primer
  misc_binding 489..513: 12-477-151 potential probe
  misc_feature 419: n=a, g, c or t
tgtattagtcttctatacctatctcctacagaaaaaatcttttaagacttatcagttactgtgacctaccatatcatggttgaattcctccatgttaagaccctactgtctagaagtatggtgttagcagatgtactcattgattggtactgtctgtagtttcattttgaagcataaacctgagtaacattcagtaagactctgtatgttcagaaaagatgtcacaatattaattgagcctctaacatcactatttatgtttctgaacatttttacatactgtcaaggcatctgaatatattcttaaagttagaaaactgtatatgaagcattactgatattgctggtattactggaaagaccatatcctaacgagcttgctaattagtactctgtttctacatttcatgatataatcnaggtgtttttaaaaaaacattttaacagctttattgagttataattaacataaagttaactgcacatatttaaaatgtacartttggtaagttttgatatatgtatacatcataaaatcacctctgataataagtatattcattatctccaaaaatgtcatcatgcccctttggtaatttcttcctctggccatcccatgcagctgatttgctttctgtagtttgcattttctagattttcatatttaagaaatcatagtttgcatttgatatctagtttcatatacctaggaaatcatccagcatatcctcttttggtctgccttcttagagtctacataaatattttgagatccatccatgttgttacatgtgtcagtagttcattccttttcgtcgctgagtaatatttcattccatggttataccagtttgtttatacattcaccatttgtgttgcattcagtttttcactattataaaaaaattatatgaacattaacatacaagtttgtatgtatggactaatgcttttcttcatcttattaccctaggagtagcgtgttgttaactttttaagg

SEQ ID NO: 483 - DNA, 1000 bp, Homo Sapiens
  allele 501: 12-479-214 : polymorphic base G or T
  misc_binding 481..500: 12-479-214.mis1, potential
  misc_binding 502..521: 12-479-214.mis2, potential complement
  primer_bind 288..305: upstream amplification primer
  primer_bind 753..773: downstream amplification primer, complement
  misc_binding 489..513: 12-479-214 potential probe
  misc_feature 519: n=a, g, c or t
gggggagaaggttacgatggaataggagacagagagggaatacatagaacctcatgcaattcttagatctgcctcctctcctgttactcccccttctctcactccactccagccatactagcctccttactgttctttgaccactctagcttccctccctgcctgaggcctttgtatcagctgttccctctgcctggaatggctgaatttccttacctccttcaaatccttgcttaatccctccttctcaaagagacctaaacaccctggccaccttctttaatataatattctgaccatgcacctaacctcacaccctgatcccctgctctaatctgtctttttcataatgtttatcaacttctgactttctatatagttatttattgtgcatgttgtgtgcctccccttgctaaaatgtaagctccacaagggcaggcatgcttgtttgttatagtcagtgatgtatcctaagcacctagaacagtacttgcctgatgktgagtgctcaatgaacantttgcagaaaaatgaatgaatgaatgccaggcattcataagcccacaaaaaaaatctatgtgtcattctacaccttcactgtagcctaatgcttcatgctccaaaaagaaagaagaggcatcattttctctgtttcctgtgctccacctctcgcacattccccactctcctagctgctgtctttcccctgacttttttgtctagtaacaagaactccctgcctggtgaaagtcggcattttcttctcaatttacttctaaatattagtgcttttgtttaccctgtgaagcagatggtaacagttaatgtaataaccagactgtctcctctctcttgtttgacacagtagatgtcatgagccatattttcccttggttatatttgttaaatagaagacaggagatctgctatatggtcaacattaggtctggtcactgcttttatattgttaacactgtgtttcctttcatatatttacatc

SEQ ID NO: 484 - DNA, 1000 bp, Homo Sapiens
  allele 500: 10-290-328 : deletion of G
  misc_binding 481..499: 10-290-328.mis1, potential
  primer_bind 174..193: upstream amplification primer
  primer_bind 573..592: downstream amplification primer, complement
ctttgaatgttcaaagaaaccaagtgatctctatggctaggcattccctttaacttatgtgatgagctaaaattttcaaattgcaaaaatatagaagttctggacagtgttaacgataggacagcctacctcaggactctcagcttccttattacagtccagtttgtcacttttctccctcatgtccactctgcaggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaatggctttgtagaaacacacactttagagaatacatttcctgtttaagaactgaaatttgcttggggtaggtacatccatatcatcagtggaagtgtgttgtgccctagttttagaaatgcatgctgaagtcatgaccggttgtgtagggacacagcagcctgacccgtgtgctggccgttccgaggactactgacatatcctgccactctgactgcttctctcttgatggaaagtttcagacagaagctgataaagcagctgagccctttcattggttataggaaaacaacagataggaaggcatgtgggggacatcaggcaaacacatagagtagccagagaagggagtcatcaactgatagcacaaaacaaaacaggttatagaaggctgggcgtggtggctcatgcctgtaatcccagcactttgagaagccgaggcgggcagatcacaaggtcaggagatcgagaccatcctggctaacacagtgaaaccctgtctctactaaagatacaaaaaattagccgggcatggtggcgggtgcctgtagtcctagctactcgggag

SEQ ID NO: 485 - DNA, 49312 bp, Homo sapiens
  misc_feature 5466..7466: 5'regulatory region
  exon 7467..7725: exon 1
  exon 20256..20355: exon 2
  exon 36905..36975: exon 3
  exon 45167..45248: exon 4
  exon 45728..45965: exon 5
  misc_feature 45966..49312: 3'regulatory region
  allele 7564: 10-286-289  : polymorphic base G or C
  allele 7619: 10-286-345  : polymorphic base A or T
  allele 7649: 10-286-375  : polymorphic base A or G
  allele 17258: 12-425-57  : polymorphic base A or G
  allele 21590: 12-421-135  : insertion of T
  allele 21595: 12-421-140  : polymorphic base A or G
  allele 36971: 10-523-232  : polymorphic base C or T
  allele 45214: 10-289-201  : polymorphic base C or T
  allele 45741: 10-290-37  : polymorphic base C or T
  allele 46029: 10-290-326  : polymorphic base A or G
  allele 46032: 10-290-328  : deletion of G
  primer_bind 7276..7294: 10-286.pu
  primer_bind 7676..7694: 10-286.rp  complement
  primer_bind 16839..16856: 12-425.rp
  primer_bind 17297..17314: 12-425.pu complement
  primer_bind 21456..21474: 12-421.pu
  primer_bind 21886..21906: 12-421.rp  complement
  primer_bind 36740..36758: 10-523.pu
  primer_bind 36997..37015: 10-523.rp  complement
  primer_bind 45020..45037: 10-289.pu
  primer_bind 45413..45432: 10-289.rp  complement
  primer_bind 45705..45724: 10-290.pu
  primer_bind 46104..46123: 10-290.rp  complement
  primer_bind 7545..7563: 10-286-289.mis
  primer_bind 7565..7583: 10-286-289.mis complement
  primer_bind 7600..7618: 10-286-345.mis
  primer_bind 7620..7638: 10-286-345.mis complement
  primer_bind 7630..7648: 10-286-375.mis
  primer_bind 7650..7668: 10-286-375.mis complement
  primer_bind 17239..17257: 12-425-57.mis
  primer_bind 17259..17277: 12-425-57.mis complement
  primer_bind 21576..21594: 12-421-140.mis
  primer_bind 21596..21614: 12-421-140.mis complement
  primer_bind 36952..36970: 10-523-232.mis
  primer_bind 36972..36990: 10-523-232.mis complement
  primer_bind 45195..45213: 10-289-201.mis
  primer_bind 45215..45233: 10-289-201.mis complement
  primer_bind 45722..45740: 10-290-37.mis
  primer_bind 45742..45760: 10-290-37.mis complement
  primer_bind 46010..46028: 10-290-326.mis
  primer_bind 46030..46048: 10-290-326.mis complement
  misc_binding 7552..7576: 10-286-289.probe
  misc_binding 7607..7631: 10-286-345.probe
  misc_binding 7637..7661: 10-286-375.probe
  misc_binding 17246..17270: 12-425-57.probe
  misc_binding 21583..21607: 12-421-140.probe
  misc_binding 36959..36983: 10-523-232.probe
  misc_binding 45202..45226: 10-289-201.probe
  misc_binding 45729..45753: 10-290-37.probe
  misc_binding 46017..46041: 10-290-326.probe
cagtgggcggggaagtactgggcccaatcagctgagactcggctccagccacacttacctttgctggtgcctcagagcctgttgccccatctcagcctcagatttccctcccatgtctgtctgtccttctctcttccacccaggcatactgtaaactcctccagtggaaaccagcatttctcctgggctgcacccgtgaggcctacaggtcccatctattcccagcctcacctcttcccttctgccactgcagaaccttccacacccctttctcctctatcctggcaccactgatgctcactttgggcacctaccagattattcaccccctcaacagccctgccccatcttccctcttttggatgcagtcaaatggagtgatttgtcaagctcttgaagctttctaggtctcagtttcagtttccttatctataaaatgggaataatttacaggctcctgggagttttgtgcaagttacatgagaccatgtgtgctttgctggcgtgtcataatggatcctggatgaggcccagacatctgtgtgtttctgtcacctccagtgtggtagcagtggtatgggctatgctgagaaacattggttaagacagtggttctccacctggctgtgcattaggattacctgggaagctttaaaacgttcaggtgcctaggctgaacctgagctaattaaatctgaagttctgtaatttttaatgacccctcctcacatgattccaatgtgcagccaaagttaagagtaaaggctctggggcagcaggactgggttgtactgactctgggccagtcactaacctctcagcctcagtttctccatctgaagaatgggaataatatatgcactttactgtttgactatgcagattagttgagataattctgtccagtggttggcatagggcctagtacagtgccttctgttgactggatttgggagctggcagggtgggcatgagaggcccccatcagagtgaggccttctcagcagccctgggctcatccagaacacctcaggcctctgggctccaggctgtcccgtctcttgctgctctatcccagcaagttcaacagtcgagctctgagcatggcctacaggagccagggcacgttcacgccagtgaccctgttttaaagtatctaatacaaagtactattcagtttaaaaagtttgtaatgattccatgaaaaaggcaaaccaatagtattagttgtttttgttgttgcttaattgccaatatgcagtatgttacctaatttatgggttcaaatttgatttaaaacacaaaagcaaaaaaaaaaaaaaaagaatagaaagttttgtttcatgtgtggtaacctggaaacatggccaccatttatattattattattattttttgagacggagtctggctctgtcgtccaggctgcagtgcagtggcacgatcacagttcactgcaacctccgcctcctgggttcaagtgattctcctgcctcagcatcctgagtagagtagctgggactacaggcacgtgacaccatgcctggctaatttttctatttttagtagagacagggtttcaccatgttggccaggctggtcctgaactcctgacctcaagtgatccgcccacctcggcttcccaaagagttgggattagaggcgtgagccaccgctcctggccataatattatttttgtgaaaatatgtgttctgaggtctaaacattcagcttacaaatttccttttggaacgtaagtttttgtagagtatgtaagtgtatgagtgtgtgttttgaatgtgtgatgggagtacatgaatgtgaatgtgtgagtgcacaagtgtgtgtgcgtgtgtgtgggtgtttatgagtgtgggtgtgtgtgcgtaggaatgtgtatgaatctggatgtgtgtgtgtgtgactttgtgtgtgtggggagggctgcatgtgctgagagctgtcaagaatggggacttctatttctcctcaccaatctctagatcctgctttattttatcctctcctaagccttatgcaaacttaagacaactcaggttgagaccctctattactgtcaaaagccattttgaagcaattcaaatgttctgtttctattcttctgggaaatctgtgctgtctcagaaattctaatggcattctaaaatcatctgttgctttgtaatatggccttttcaacaaataggcctagtctcttctgctttcgcccagggttggagggcatcaggatggcagagagaatgggcagggtggtgacacctgtggacagccagcatcatgccgggttctgtgctatttgcttccttcacatgacttcctttattcatcagaggaaccctgcaaggtcagtattattatttccctttgaaaacacatgtccaggaagtttagcaactttccaccgtgacacagagataggagcttaaaccttgtactctttttttctacactacattggtaactgatctttattttccttgcctttcttctctttttctgtctttatctttgagccttgatatgtcattactggtgctgggtagtgggcagtttctgctggaaggtagctggcattcaactgtaaccctttgccctgtctggtccagggcaaagtctcctcaatgggaataaaatgcctttgccttctttagctcatttcttcacactcagggctacaaagcaaaatgctgcagtttctgaaatgggagaaaatattccgtaggatgactaaaatttcctaaatttttgcaacatgtagcaaaatggagcataatttcaaattgtgtttatctgagctttgcttaaaaacttactgtgttaaagccactattaaacccagctactcaggagactgaggtgggagggttgcttgaaccctggaagttgaggctgcagtgagccatgatcatgtcactgcactccagccagggtgatagagtaagaccctgtctcaaaacaaaacaaaacacagaaaaactgctgtgtagttacaagattcttcaactagtcaggacttctagcaagataatgtaatgaactctgggtacatggagagttatgtggtcattgataatcatgatcactctgatagttcctgggaaagaggtgtattttctgtctctttctgctacctggcctgatggcagtgaggacagccctgctgtagtgctcagcagaaacctggatgatgtgctgtcaattttggaagggtagcaagtgaacagagagggtgagaccagggaataatttgcgggggttgcaattggtttgaggaaaaacctttttttttttttttttttttttttgagatggagacagagcttggcagagcaagctctgtcacccaggctggagtgttgtagcgcattctcggctcactgcaacttccacctcttgggttcaagtgattctcatgtctcagcctccccagtagctgggattacagatgtgcaccatcatgcctggctaatttttgtatttttagtagagatggggtttcaccatgttggctaggctggtcttgaactcctgacctcaggtgatccacccaccttggcctcccaaagttctgggattacaagtgtgagccaccatgcccggctgaggaaaaacatttctatagtttaatatatcatttcttttcatctattaccaaaattatactgaaagagttacatttagagttcacatttcatgaaagcagttcttttacatggttcaggtttgtttttatgtgatcaaatcttggcctctctgtttcaccttacctagagtatagttttggtaacagtgattcagtagtaaccaaagtcctcagaaagtcttttaggtttcttttgagtttacatagataataaaaatattttaaaaacattttactatcattactgtcttattccattttgttgctataacagaataccacacactgggtaatttataaagaaaagaaatttatttctcacagttctggaggttaggaggtttaatatcaaggtgctggcatctggtaaggacctttgtgctatgtcatcccaaagcgggggggcaagagagggccaagctcacatttataacaatccactcctataacaacattaatccattcatgggagcagagctctcatggcctaatcaccccttattgtcctacctcttaataccattataatggaagttaaattttaacatgagttttggaggggacaaacattcagaccatagcaattaccagtatgctgtttgtcctcttattttccttttcatagaaaaatgtaataaatggaacatactagaaggatctatgggaacaacattcagggaaaatgccattcctcttcaaccaatccagggaaaacgtacagagaaactctaatttttgtgagtttttgttaatgctatggcagtatttcagctgtgggtcacctggaaattttatcactgcagaaggtgataaacatttcattatacaatgctctattcttttatactttcctagaggcaataactacatataccgacaatgaagatctttttaaatagacacgtggggttttgaagcacttgagattttattgattaattgattttttatttttttactttgtgtcaaccatctcttagaatctggatttgggggactgacttaagattggctgggagaagtcagtagggaacctcaggatttgtccagaagctgggaagtttcattttttttttttttttgagacgaagtctcgctctgtcacccaggctggagtgcagtggcacgatctcagctcactgcaagctccgctttcgaggttcacgccattctcctgcctcagcctcccgagtagctgggactacaggcgcccgccaacacgcccggctaatttttttgtatttttagtagagacggggtttcaccgtgttagccaggatggtctggaactcccaacctcgggtgattcgcccacctcggcctcccaaagtgtgggattacaggcgtgagccaccacgcccggccggaagttgtagattttaaaccagttgactagtacaggtgtacccaagagtttctcaaaataagagttaccaacacccaaaagttacagtcatcagccagggccacaattctctgctcagctcctcctgctgttgttcctctcttcccgagccgttctctgactttgagagcctctgcctgtccccaggcctaatgtagacctctccttcgagatctgtcatttgggaggttattatagtagatggtgatatgggttcagggcagctagtttgcagtttagaatctctgccatgtactgaagcccaaaactattaaactgagtatacaagaatgttttggtgctgccccagcttcttggctctactttcttatctaatcttagttgtcaatgatttcaagagcaaacagccaaggaagcctgaagaccaacagaaactttgagcagacctggcttgcaactatttataaattaattttgttattccttctttcctgtatatgtgtagttccatgaattctactttgaactggttataacatcttactggttccctcatgaatgagttacataaaaattttgatatgttttcattttatgttgtatgaaaggcatgatttttgcctctgaaagtattttttaacattaggtacattatatgctaagtacttgtctagatactttatgtgtttattttgcagacacacagaacacatttgtatatgccaggtgctgttttaagtgctctataagtattaactaattcaatccttagaataggattatgtcatttaaacttctcttcagctcttattagccctatcttattaaatggaggctcagagaggcccaaggttgtgttattaaattgtagggtctgtgtgaggctgaggcaactgccctccccagaagacactgggagctccctgctagggactaaatgtttgtgtcccctctgcaattcatatgttgagaccctaacccccaacgtgatgttatcaggcatttggcagataattagctacaggtgaggttatgagcataggcccccataatgggatctgtgcccttataagaagtgaccaggaagcttactctttctctgtctccaacatgaaggtgtccttctgcaaaccaggaagagggccctcaccaggaactgattggccagcactgtcatcttggacttcccagccttcaggactgtgacgaataaattgctattgtaagccacccagtctatggtatctttgttatagcagcttgagccaagatataccctctaatggtgctgtaggatggggtgaggaaaggcccccagctctggtttttgggaagctgcatctttatttttattatttgtttgagacagggtctcactttgtcacccaggctgaagtgcagtggaacgaccttggctcactgcagtctcaggctcctgggttcaagcaatccccttgcctcagccccctaagtagctgggactacaggcacgtgccaccatgccctgctaatttttgtatttctttaagagatggggttttgccatgttacccaggctggtctcgaactcctgagctcaaaccatctgcccatttcagcctcccaaactgttgggattacaggcatgagccatccttccaggccagaatctgcatctctaaagagcagattctcctgcctcagcctcctgcgtagctgggactacaggttcgtgccaccatgcccagctgattttttgtatttttagtagagaaggggttttactgtgttagccaggatagtcttgatctcctgacctcgtgattcaccctccttggcctcttaaagtgctgggattacaagtgtgagccatcgcgcccggccggtttatttttttaaaaatggctgggcacagtgacttgtggctgtagttctagctacttgggaggctgaggcaggaggattacttaagcccaagagttggaggctgcagtgagctatgatcgtgccaccacacactccagcctgggtgacagatcaagaccctgtcttaaaaaaaaaaagtatgattattatcagagtctctaggtgacagtgagaggcagcctggtgcaggggatagggcacagttgtaatctgctagactgggttcaaatcctaaatcggccattcagagcgtgaatacattagaactggcttaaattagcatttaaaatgtcaacaggattaagtaagtagttccttctcactttttccacaggaggtgagaaaggtctcagcaaggccctaggagggaagggcgtggggatgaaagggatccagagagtctgtgcattggcagagaagatagtgtaactggcactgcggctggagggctggtcccacagtgagctacagccctgcccgctggccgtgggagaggcttaaaacaaacgccggaagcaactcccagccccataaagatctgtgaccggcagccccagacctgcctgccttcctgacttctgttccagagcaaaggtcattcagccgcttgaatcagccttttcccccsacccggtccccaactttgtttacccgataaggaaggtcagcattcaaagtcaagwagcgccatttatcttcccgtgcgctctacraatagttccgtgagaaagatggccgggaactcgatcctgctggctgctgtctctattctctcggcctgtcagcaaagtaagaggcatgggaagttcgtgtgtgtgcgcgtgtgtgcgtgtgtgtgtgtgtgtgacaaggcttgcgggagagagagggagggagggagatgggtccggtgttttgtttcctacttgcccttgcaggtagctctgggtcctcagagcacagtcgcctcagggtcacccatgccgcctgctaccctccttcccaggggcaagcagagactgagaacattccagagattagttctcccaactggaacgctgtggggcctcagagctcagcgattctgcatcatctgtgattacgacccacagcccgttcaaacgagcgttagtagcctgctaacctgcaggaagtggtgtgaatattaattacaagtgttccaaaggaaacgtgcctgcttctaaacctggttgtgatttcttgaacgttgatgttttaattaatgtgttttcttaaataaactgcctatggtggtatgattatcagattgaaaaaaacttccttcagaaatattagctttagattaagtaattagctctaaattttaaaacagcttcccactaggattattcaatatctcgactgcctggttaaatagagggcttttactccatgggagtcacatttgctcaattcatattatcttacctacaatgtcagctggggaaaggggtccgagtgcaagagtgcaagacttcttaccaagcatgcatatttctttatatttccaagtatgcctgtaccaggaaatagggccaagccgtagactgctcaggttacacaaacagccagaagcaggaaggcctcacagctgaggatccagtccaggcctccgtgcatgctcaatgtcttgcctagccagtctgttttgagattgtatgaagatcttgaaccttcagactcacgttttgtggtttgattcacacaatctgttgtggagaagagcaggatatttgtttctaattaaagaagcacttagatctgttaaaaggaaaaccctagacaaattacatttaactgagtttaattgagcaaagaacgattcacagttgggcatggggaaccggaataggttcagagagactctggggctgccacgtggtagaagaagatttatggacagaaaaaggaaagcgactcccagaaaacggaagcatatagttcacgatgtacggagaaacctttaggctgaacttaaaatatgtcagaaggcagctttaggctaaacctaatttagcaggtctaaggctcactgttggtagcatcctgactcacaggtgctaccaaacctgcatgcgcctttatcctaggcctgcaggtccacagatgtcccaaagctgacagaggtgctcatcctccctgtttgctgcttgtgcagggggctgtgtgaactggggccagaatgttagggggctggatggagtgggggtaggggtggggagagaggagaggagactgggtgaatgatgattaatggtggacagggaatgtttaatgacaaggtgttagggccgggcacggtggctcacccctgtaatccgagtactttgggaggccaaggcaggtggatcacgaggtcaagagatcgagaccatcctggccaacatggtgaaactccgtctctacttaaaatacacaaatttgctggacatggtggcacgctcctgtagtcccagctactagggaggctgaggcaggagaatcgcttgaacctgggagggggaggttgcagtggactgagatcacagcactacactccagcctggcaacagagcgagactccatctcaaagaaaaaaaaaagatgttgatgaagagttgaactttgtaaaataattgaaaagctgtattctgagccaaacatgagggacgagtggccggtgacacagcccaaggagattctaagaacatctgcccaaaggggtctggctacagattggttttatacattttagggagacataagacatcaaccaattcatgtaagatgtacattagtttggtcccaaaaggcgggacgggagacataagacatcaaccaattcatgtaagatgtacattagtttggtcccaaaaggcgggacaactggaagtggggcatgggcttccaggtcataggtggatttaaagattttctgattggcaattgattaaaagagtttatctacagacctcaaatccatagaagggagtgcctgggttaagataaggggttgtggaggccaaggttcttactatgcaaatgaagcttccaggtagcagcgtttggagagaatagattgtaaatgtttcttatgagacttgaaaaggtgccagactctgttaattctctcctggatcagagaaaagacctggcaagggaaagggattttctacagaatgtagactttccccacaagagacaactttgcaggaccatttcaaaatatgacaaagaaatatattttagggtaaaatacttcaatttctttcaaaggcctgctatctgtcatgtgatgctatactggagtcaggctggaatttggtgtcttatttctacaaaaagtcttaagtgttagattttttaaagggaaggtggggttcaagaaagacacagagagagagatagagagaggagggggagggggtagagggggagagggagagagagagaggctttacaacaacacaggtttattacaaaaacctgtggaggtgggggaccagcttaatgccagagcccgccattgcttacaggctggggtatgtacaggtatgggcaggagggttttgggcagtatggcttgctgccctggaggatattgataagatgttcttatgttcaggtggtttggccagggatattccttgggctctgtcaggatttgatagggatatttcttcagttgggtctttgcttggcagggtatgataaagatgttcctgtgtcttgtggtcaggtggctaggcaggatttctcagggcccgaacccccatggaatgtttcactttgacaaaggcctgtgaaatggcagggggcttacaaaatggtgtagtttggactaacattaaggtctgtttcaatgttaatgctggtcagttatgcctgaattccaaagggcggaggatataatgaggcacatctgacaccttttccccatcatggcctgaactcgttttttaggttaactttggaatgcccttggctgagaggaggactccatttagatggttggggggcttagaattttatttttggtttacaaaggagagagagagtgtgtaagagggagacagagagaggaagacacaactgtttagctggcattaggaaccagaatttgctccttttgcaagtctgatgttcatggagtcgggacaccatgtgccatggttgaagcagcttaggttttgaagacacagagctgtatctgttggtctagccacttcccagctgggtgtccccgttcaggatacactgcccttcaatgttaccatcaaagagggtttaatgggacgctggggaggaaatcccaccatagttcctggccccatgtaggcgctcagcactgtcagttcccatcctaaggtccttcttcgaagagagaagtttctgctgcatggagaggtagagacagggtgaaggtacccagctgtggctgggtgggcatcacagggggtaaggggcagagaaagcttccccttcaccctctgaaggttcactgaacgtcaactgacaaaaggcagattaacaggagaaaggctgtgacaatttattttaatatgcacagcatgagagaatggttgcccaataatccaaaggggtacagcagtttgtataccattcttcacaggggagggaggaaatggggaatgcagacaattcttttgagtggtagtaaacaattattagggagaatgaatggactgggagacaaagtaacttgtcaatgattctctggaatttgattggccagaggggtaggcttaatctggtgggaaagttcgtccaggtgtgtgcattcctcggtcttcttttccacatgagataatgaggtctgagggaggagacggcaggcaattgtgtttgtcttagggggtctggtttctaggtagataagggagtttcagaggactgcccagctgcatcctgtgccttggtagagaccacaggttgagacaggaggcagtggagaggtcacaaagaccttgaggcagcttctttagttcagtcatattttgaggtgtaatattctgatttccttcggtggggggcgggggggggggcggttaacagaaataccaaactctgtgaaatcttttaaagaggtttattctgagccaatatgagtgaccatggctcggagaaaacacaaacccaagaagccttcagtgggtggtcccaaggcaattgggttacagtttggttttatacattttaaggaggcaggaattataggcaaagacataaatcaatacatggaaggtatctattggttcggccccaaaaggtgggatatcttaaagccagggggcttacagattataagtggactcagagattctcagatttgcagttgttaaaggagtaaagctttgtttaaagacttgaattcagcacaaagaaatgcttacattaagagaaggggtggccaggtgtggtggttcatgcctttaatcaagcactttgggtgaccaaggtgggtagatcacttaagcccaggagttcaagaccagcctgggcaacatgatgaaatgctgtctctattaaaaatacaaaaaattagctgagtgttgtggcactcacctgtaatcccagccacttgggaggctgaggtgtgagaattgcttgagtccatgggttgcagtgagccgagatcatgccactgcactccagactgggtgagagtgagaccctatctcaaaaaaaaaaaaaaaaagataaagaggtcatgtgatgctataccagagtcagttggaaagtaagccacatactgggttaatttaaaagaactggcctaatgagatttgatggtttgtagggcgtgacttaacccttgccttgtaaggccttaggtcttgtctacaatttgatgtcttcttgctgcagccggctttgttagtcttatgatccccattttaaccttaatcctgggcagttgtgcctaaactccaaaagggagggggcacaaccaggtgtgtcctacctcccttcccctcacggcagggaattcagtttttcaggtctctctggggttccctcggccaagagtgggtctgttcagttgtttgggggttaggatttcatttttggtttctcctcagcacatgtgtatctctggagaaagctagggaaagaggaaagacaggcaaagcaaaaggagattattatctagaggttttaatcaactcataagggaaataaagttgaaactctacagaaaaggaggtgaaatagcaccccactgtcatcatatattcatcatatatacgtatatatattttcagacctactgctctgtcgcccgggctggagtgcagtggtgtgatctcagctcaactgcagcctctgcctcccaaggtcaagcaattctcctgcctcagcctcccgagtagctgggactacaggtgcgccaccatgcccggctaatttttgttgttgttctttttgtttttttgagagggagtctcactctgtggcccaggctggagtgcagtggtgtgatctcggctcactgcaacctctgcctcccaggttcaagtgattctcccggctcagcctcctgagtatctgggactacaggcacacgacactgcacctggctaatttttgtatttttagtagagatggggtttcaccgtgtgggccaggctggtcttgatcacctgacctcaagtgatccacccgcctcaacctcccaaagtgctgggattacaggcacgaactaccgcacctggccccactctcatcatattattccaaaaatagccatggtctctctgaggcccctcacctgagagaacagaagggcttctatcccttggggctggaggtgagcccagctgaatcctctttcttggggctggactgggagtaggtgggatatctcagtacctcttccatttactgaagctcattcctcacacttgctagtgtcacaaacagatgcccattgggtgcaattaacgtaagaaaagatagcacttttaaggcttgcttactcccagcctcattttgaagctctaggctcctgtgcattactaattcataagtctaggagcacatacctttcattatttccattttataggtggaaacaagaagacttgccaagtattttctgcaaggctgtgaagcatgttagaagcaatggtaatagcaggtgcagagtggccaagtcctcatttccccctcaatggacaaatccctttagctgagcccatgagtcattggcctttccagattgatgctgccctggagggatggagcccagggttggagacagtcagggcccatctgtacattccttctcctcactctgctctctcaggctgcagtatgaatgagaaaactccaatcccaagcatttacacacttttttttttttttttgactcggagtacagtggtgcgatctcagctcactgcaacctccgcctcctgggtttcagcaaatctcctgtctcagcctcctgagtagctgggactacaggtgtgcaccaccaaactcagctaatttttgtatttttagtagagatggggtttcaccatgttggccgggcttgtctcaaactcctgacctcaagtgatccactagcctcagcctcccaaagtgttgggattacaggcgtgagctactactgggcccggacagcatttacacactttagatattcagtgacaatgtttaaatcctaaacaacagcttatttgtagcagaaggggattagtggaagggaagagcctgctttgagagcccttgctacaccaggatcaatattgacttcttgtgagagggggagatcatatcctgttccagtaggaaacacattgcctctaatactcttaacacagggagagacccaaactatacacttggtgtggaattttaaaaggaaacatttttaaaatattagcaggtaggaaacagatattgaggtactaaaacaagtcagacaaggagatagtgggggagacaactggtaaggagctaaaactgaaataaataatgtgaagcgaaataatagttactgtaacccaactgaatgtgggtccattcacccagcatacagaaacaaacacaagcaccaggatttgcagtgacagaaagggaagcattgattgcagggtgccaagcaaggagaactgggcagctaatgcttaagaccctaactccccaatggctttcaggcaagggttttaaaattttatttattttattgttatttgaaacagggtcttgctctgtcacccaggctggagtgcattgatcctggctcactgcagccttgtcctcccaggctcaagcgatcctgcctactcagcctcctaagtagctggaactacaggcgtgcaccatcaccacacctggttaatttttgtatttttattttctagacatgggttctcactatgttgtccaggctggtctcaaactcctgggctcaagcagtcctcctgcctcggcctcccagaatgctggaattacaggtgtgaaccaccatgcctaaatgggtttttaaaatttgagatagggtcacaccatgttgcccaggctggtcttgaactcctagtctcaagtgatcctcccaccttggcctcctgaaattctggattacaggagtgagccaacagacttggcccaagcaagggtttttaaaggcaggggtatatttcaggaaagcagaaggtataggaaagataataaatcaatacatggaggttataccttggtttggcctcaaaaggcaggatatcttgacacaggggcttacaggccacaggtggattcagagattctttggtttgcagttggttaagggagcaaggctttgtctaaaaacttgggtcagcagaaagaaatattaaggttctaagctaaaaagtatctgagacaatttagaaaatttattttgccagggttaaggacatgcccgtgacacagcctcaggggctcctgacaacatgtgcccaaggtggtcagggcacagcctggttttatacattttagggagacatgagacatcaattcatttatgtcagatgtacattggttcagttcggaaaggcgagacaactcaaagtctatatccaggtcataggtagataggagacattcttttgagtttctgattagccttttactgaatcaaaggaagcaatcagatatgtatttgtctcaagtgagcagaggaatcactttgagttctgtctgtcctttgtccacaaggaatttccttgtgggtaaattgtgagggagctatgtagttttttttttttttctttttttatctggtgtctaggcaaagtggctcacttctgtaatcccagcacttttggaggctaaggcgggtagatcacttgaggtcaggagttcaagaccagcctggccaacatggtgaaaccccatctctgctaaaaatacaaaaaactagctgggcatggtggcacatgcctgtaatcccagctactcaggaggttgaggcaggagaattgcttgaacccaggaggtgaaggttgcagtgagctgagatcatgccactgcactccagcctgggtgacagaatgagactctgtctcttaaaaaaacaaaatctttatagctatcttatttaggtatagaatgggaggcaggtttgtccaatgcagttcccagcttgacttttccctttggcttagtgatttgggggtcctaagatttattttcctttcatgaggtttaacccgtgtgtgtgattctctgcaggcccctcaggaagaaatttagaacagggaatggtggtcagaattcagtcctcagttcccgcttagctgaggtctgtgtgacagtggtcagcattttccatctggtggaggtcctggtttctgagaaacaactcaagaacttatgtgaagacgttgtctttagtttctatagggaaccgaacgtcttgtaactctgtcttatttgggtgactattatttaaactattattatcttctcgcttagcgggactgaaggatagcaaggtgcttggaatttcccttgaaggaactcaagagtttttatttccgtgcttgaggtggctagcaggtccctaagagtgttccttgctctgtctccatgccagaagtttattatggggtgaaaagaggaagttaaggacaggaggcaagacctactgaaggctcaaaaactgacagaggaggaagtatggatgtggaagtgaaagaagtccacagagctcatcacaagatgaaggtggtcccaggcatcagagttgattatctaatgaaataaaggagaagaaagtcatactgttttataacagggaaacgtcggcaggtaggagccatcatccccaragttttcttgtacctgctgggcaaggtgtcagagccctggcaatggaaagtgattggcccacagggagtaagaatttaccgacaacaatataggtttgaaaaggaaagttttattagattgagagaaagctgcagaagagtgcagcgggctgcctcagcgagaggactgagcgcgccggggaggattttccttaggggtatttatggaccttaaagcaagagcttaggggtaatttggtccatattagccacatatgtcatgataaatgattacatttgtagacattttggtgtcgtaatgtcagcaagggttgcacaatgagttttgtcatgcatgcattccggagatgtatagaggtagagaaagtctagttacatataaattttggggaaagaagcctggaaccggccttagatatagggaagatcaattatttctaaactcctcagataaggagttctgcctctggatggtcggcttcatggccaccaggtggtctttgctctctttagtggcccctccctcctggcctcctcatctccaggcaatctttatgtcactatagattcatttgcattttgagaattttatataagtgaaattattcagtagtactcttttttaaaatccttgctttcattcagcataattattttgagattcactcatttttggggggtatcaatagtttattcctttttcttattgttaagtagtatcccattgtatggctctatcatgatttatttatctactcacctgttgatggatactcttgtgagtcagggttctccagagaaacagaatcaatacacacactcacacatagacacacacacggagaattattttaaggaattggctcacacagttgtgggggctggcaagtctgaaatctgcaggaaaggctggtaggcaaaagttgatgttacaatctggtgttgaaggcagtctggaggcagaagtcctttctctttgggggacctcagtcttacctcctagggccttcaactgattggatgaggcccacccacattaaggagggtaatctgctttactccaagtcaattgatttcaatattaatcacatctaaaaaaacaccttcacagcaacatttaggctggtgtttgaccaaacaactaggcaccgtatgctagccaagctgatgcataaaattagccatcacagagttgttcctgttacaaacaaagctgctgtgaatatttgtgtacaattctttgtactgaaggaaataaaaatattttacccaagatagatttctttgacagattttcaaatggccctgcaaagctgttttttgtgggggaactttgcattgtggagaatctccatgaatgcagcaaggccttcccttgtccagatctgggagagattaatggagtctgacacctgtaaagatctggaagaaacacttaccatctattttctctaaggggctgctatctgtgagatttcgtctgtataacatgactcccttggctagctgagcctcctcttcttcccctcccatatcctgtcttgccactaaaacctgacttaccaccataacctgtttttttggccatgttctgagcctgcattgcttctgtgaacccaaaatatctgataggtctcaaccaatttagaaagtttattttgtcaaggttaaggacatgcccgtgacataaaaggacatgcccgtgacatagcctcaggaggtcctgatgacatgtgcccaagatggtcagggtacaacttgcttttatacatttcagagggacatgagacatcaatcagtatgtgtaacatgtacattggtttggtctaggtaaggcaggacaaatcaaagcaggggcttccaggtcatagatagataagagataaaggttacattcttttgagtccttgataagcctttcactgaatacacaatttagtctggctcagtgaatctgcattttttttttttttgagacagagtttcactcttgttgtccaggctggagtgcaatggcatgatctcggctcactgcaacctctgtctcccaggttcaagtgattatcctgccttagcctcctgagtagctgggattacaggcatgcaccaccacgtccagcaaattttttgtatttttagtagagacagggtttctccatgttggtcaggctggtctcgaactcccgaccttgggtaatccacccgtctcagcctcccaaagtgctgggattacaggcgtgagccaccgtgatcggcacatttttacataagcaatcagatatgcgtttgtctcagatgagcagagggtgactttctgtccagcacctgtgaagataagcttttccttgtgggcaaattgtgctttgtagctatcttatttaggaattaaaatgggaggcaggtttgcctgctggagttctcagcttgacttttcccttggcttagtgattttggggtcctgagatttattttcctttcacatttctgtagcctcaagatggcatatgaacttctgtacctcactgtggagcggggtctttgttctgaaggctgctatgtatacatatgaaataaatgtgtgtgatctttcttttaatgtctgttaattaatctgcctcatgtcagtgattttcagtgaacctccagggggccaagggctttggcccctacagtatggacatacaattttgtttctcttagggaaatacctatgaatggaatgactgggttatacattggaggtatgtctaactaaaagactcccttccaaactgtttttcaaagtggttgtaccgttttacattcccaccagcattgtatgaaagtttcagttgctctcatatcctctcctgtcttttttaattgctatcatctgtctttttgattttagacattgtaataggtatgtagtactatctaattgtgatttaaatttgcattccactaatgactaatgacgtgccccatctttaacgcaacatttccctttacttgcaggttattttgctttgcaagttggaaaggcaagattaaaatacaaagttacgcccccagcagtcactgggtcaccagagtttgagagagtatttcgggcacagtaagtaatgcttcttccacccttcatggatctgtgcctgccatacagacacaattcctgactaggggaaagggatatggagaagaccctaagttcatgtgcaatatctagttataacaagtcactcttcacagccaagaccgttctcagaatccagaaagtttgaagggttcggggcatgaagtctctgcccacatctattaccaattcagcagggtatatttacagaaaaggctgggatctcaggagggactgctgtgtctcccaaggagggtcactgggtcaaagaggccccctggagccttgtgagaccacaatagtctgaagttggattcgttatgctacaattttctatcttattttttcctccctacttcaaaacagaggtagatcaggattaatcttttgccagtttctctgtgaaccatttcttaaaatcagaaacctgtaagaatgagaaagcttgccagctcacatgcatgcgccatgttttttgatcatcttgtgctccttgttttttcagacccacacaaaatgttccaccataaacaccgtgaacttgcctgctgcaggaatgctagggcgtactttatatttcatcccccaaaatacgtgctttaagaaacatttcatgcgtcaccactgatatatcattgggttcttttgttaccatcttgggatttttcatttatgtttacaagtgagattggcctacactttgcctttcttgtctggttcttgtctcattttgatacagatgaacctagtgtcaaatgagttggaggaagcatcctgttctactttctcagataattttaataaggttggaagagtgtgttccttcaaggttgtgtagaacttgccttaaaataatctgggcctaatgtttttctggtgggaaatttttaaattatgggatttgcattctttaatgattattggactaggcaggctttttgttacatcttgaatcaattttggtaggccttggtccttgagatgataacattggtctcttgattatccacttgctccaaggagggttttacagactactccctaggcttgaaagcgtggggtgaataccaccgggagtacacgagataattgtaagaggtgtgtagacttggttttaaataacattgaactacatgatgagaagtcattctcatttcaattatctttgaatccttatggttaagtcaagtggaaagtattggtttggagccagcatgtcccrcacctcaaaattaatgtttatttttatcaaagtaatttatgtacgtgatctgaagataaagtgggattacaggttttatgacaacaaataactcttccttgtccctacctcccctctccctctatccctagagataaccctttttgattactactttgggtatttacttctgtatttctaaacattatactttcactgctatttattgattcacaaattttagacattgtcagttggcttctttttatggaagaaataatttcatgctcctttacttcttcttttccttacctcatccttccagtaacattatatcactctgttaggttaaatcaatagccaatgtttataattattgtgattaagaaaataatgttgaaagcagggccttatagtatactgtggttacatttccttcttgtgcaattttttttccctagggttaataattgctctttatttctttgtttgcttagtttcatgcccaaatcttctgcagaactgaaaatctcctttcgttacattcaaatgcattagataatctagtaatacatttttctgtcttggagtcatttctgcctgagtcctccacttttcgcttcaagttgcgggatgctcttggtgcttgctgcacagctgctatcctgggacttcctgtcaccatcctagaaatttcccttatactgtcctgatttggatttcctggacctcctgttttcctgtttattggttttctctctctttttagtggagtacacccttcagaagcttcctgagaaagggtgaatgtttggtaaagttttgagacttcacatatctgaaaatgcacctttatcttgcctcacagttaagggatggcttggttaaatgcatttctgtattagaaatccttacccttagagtttttgaaaaaatttgctccatggcttcctagttcccactgatattgttgagatgttctgtgctattctgattctggaccttttgtttggaaactatggaagcttcaggatcttgcctggcctactgtcccgagatgttaatagcattgtgcttgttgagaggctttttcttcactgtgctcaaccccaggtgaggccttttcacagcctgaaaactcatgtccttctgttttagaattttttttttgttttgagacagggtctcagtgttgccttggctgaagtacagtggcacaatctcacctcactgcagccttgacctgccagcctcaggcaatcctcctacctctgcctcctgagtatctaggactacagatctgtgctacaatgccctgctaatatttgtattttttggtagagataaggtttcaccatgttgcccagtctggtctcaaacatctgggctcaagcaatctgcccacctcagcctcccaaagtgctgggaatacaggtgttagccactactcctggcccagaatattttttaatattatttcttcccccagatttcctctccttcattttctctgttctttcattcttaaaacgcatactagttgtgtgttaacctccaggactgatcctctagttttcttttatcttcaggttttcataattttggatttttgttctttcagaggaatttcctcaacttctaactttttatctgaaatttgagatatcataattttaatttccaataacttatttttattctctgattgctttttagttgttggtgctgatgttaaaccgtcacttttttatttcattgatgtagtttattctcttatatttgaggattttaattataattttaaaaattctctgtaacatttctgtttcttccaagtatctttgtgtcttttttggcctttgtctttcatttgtatttattatttacccattaagtatttattgagcacttctgtgtaccgggcattgttataatagcttggcctagatccatgaacaaatcccacaaaaatccttgccctcttggagtttgctgaggaagccagaaaataaacaataagcagatgatattataagaaaataatataagctgggcatagtagctcacacctgtaatcccagggactcagtaggcccaggcgggagaactgcttgagaccagaagttcaagagcagcctgggcaacatagcaagagccccctctctctattaaaaaaaaattaaaaaattagccacatgtgggtacatacctgcagtcctagctacttgggaggctgaggttggaggattggttgagcccaggagttcaaggcttcagtgagctatgatcatgccactatactccagcctgggcaacagcgaaagaccccaactcaaaatgaaagagaaaatcatatattatgttagaaggtaattggtgctaaaaaaaaaaaaacaaaaacaaaaaggatagcgttgtaagagggtatgggatgggttcctggggggtaagttgggtggtctgtgatatacaataaagctatgggtgtaggtcccgctgagaaggtggcatttgtgaacatgtagagaaagagctcttgggtcagagacaatagtcagagaaaagcccttagctgaggatacacccagtgggttagtcaggaggttagggggctgcagggagcctggcagggagtgggaggaggtcaactcagagaggtcatagacggctgggtcacactgggccttaaaggccactgtaggggactttggcttttctctgagtgaaatggaaagtcatgacagggttttaagcaaaagagtgacatgatcttatattttaaaaggagaatcctgtttgctttgctgagaagagcctgtatagaggcattggtagaagcagaaaatgcatttagaattccaggcaagagatgatggtggctgtgttgcagaatttttgctccttagttcagctaaaactgggttcttgtcacatggccaggaaagattaggcgtgctgacacattgaagggtgagtagagcagaatttattggatgtaaaggaaaaaaagaaaaaaaaaaaaagaaactcaacaaagcgggagggggtcctactcacaggcccctgcctcgcagattaattccaggtcaccacccacgagctggagaccaggctcctccctctgcacaaggttcgaacttcctgtggctccaccctgttcctccagtgagcatgcaggctttattcagaaagaatcagtttggaaagggcaggcaagcgggggcagttctccctcagggtggcaagtttcatcctggaccagcagtccaggctttcagccttcaagcttttttagacttgagggtggggtttcaccagggacccttggctgtctcctgtctctgtcagctagagccagggagatagcagtgaaatgatgggaagtggtcaggttctggatatattttgagggtagactcatagaattttctgacataatgaatgtgaagtgtgagaacagtcaagaatgattcttggattattggcctgagcatccatcccaaaggatggccttgcgatgatctgagatggagaaggctgcaggagaactggttttggggaagtattaggaggttctgtcttgacatgttgtgtttgagatgtgacttaaggagaggccttaagcattatgatctactaagctatttggattgtttatgattgcatcataaactgacaaatacattgttggttacacctccaagtagagaggcagctggataaacaaatctgcattttaggagagagagctgagctggaaatataaattcaggggtcattggcacaggaagatgatttacagccatgagactggataaaatcacttaggggagtgtgtgtaggtgtattagtccgttttcacactgctgataaagacatacccgagactgagcaatttacaaaacaaagaggtttaattggacttacagttccatgtggctggggaagcctcacagtcatggagaaaggcaagtcacattttacatggatggcagcaggcaaaaaatgagagagcttgtgcaggggaatgcctcttttaaaaaccatcagttttgtgttttttttttttttttttttttgagatggagtctcaccctgtcacccaggctggagtgcagtggccacaatcttggctcactgcaacctccgcctcccaggttcaagcaattcttgtgcctcagcctcctgcgtactgggactacaggtgcctgccaccatgcctagctaattttttgtatttttaatggagacagggtttcaccatgttgactgggctggtcttgaatgcctaaactcaggtgatctgactgccttggcctcccaaagtgctgggattacaggtatgaaccaccgtacccggcctaaaaccatcagatcttgtgagacatattcactgtcacaagaatagcatgggaaagacttgcctccatgattcaattacctcccaccaggtccctcctacaacacgtgggaattcaagatgagactggggtggggacacagccaaaccatatcagtaggtaaagaacaaaagaggactgagccctgatggcatcaggaggtcaagatgatgacaagggtcctgcagagagatctgaataaaggagatcttagaggttttacccaaacatctggtattaataattctcaactggctgttaagaaagaggcattagagagtgacgtggaagctccatgtgcatggctggggcttatgattggtcaggaggcagctttcttctggagaaccctcaaagtatctgtaggtcatctttctggtaccacttagtttctctagagaaaactctttaaacctccttcaggggttgaaggaaagaggggtggagataggataataggcctgacttttgagagtgcagtagtaaagacaggaaggtttttcgactgtgcagtgtgcagcatgcagattctgactgttttcaggacagaattttacccccaccctctattattcctgaagtccctaacagtctctggttctgtttctccaggcaataagcctcccacctcctgtgatggggagcaggctggggctcaggagtgggaagcagaggtggagggcagctaagccctccttattcagtttttcaaccactcttaagttccagcctttggcctctaaggtacctggggtgcccaattcctgagcttcttttggttctggggtaaggatggtctcagtcttcattgcttcttccttcagcaggcacataggtttcagctttctgtactctaccagtccagccactgttcctccatgtgctgtctttcccgcagaattttgctaatggctctcttccactcttgagagattgtttggaggttccagcaggggagcatagctactcatatacccttgaccgaaaactggtcctcctctatggaggatggtcgtcctctttgactgagcatgcagctttgggagggacgcacatggagtggggagggaggaagggaacacccgcctagccagccagatcagccgaatcaaccctggcaattgatggggtgacagatgttgcagccagattaccctcacttcctctcttttactcttgtgtctgctctcattctctttgttcttgattactcatatctatttttttttctttaactagcattttagtgaagcttcagaagtgagaagaaatgagcatgggttcaatctgccatgtttaacaggaagtcatcatgatacatttttgatatcctgtgcacacccattttcccttgtcaacaaaaagagtcaaactctataaaatacttaaagagatttatgtatgtatttatttatttttagacagaatctcactctgtcgcccatactggagtgcaatggcgcaatcttggctcactgcaacctccccttcctgggttcaagcgattctcttgcctcagcctccccagtagctgggactacaggcatgtgccaccacacccggctaatttttgtatttttagtagagacagggtttcaccatcttggccaggctggtctcaaagtcctgacctcaagtgatccaccctccttggcctcccaaagtgctgggattacaggcatgagccaccacacccagcctgaagagatttattctgagccaaatatgagtgatcatagcccatgccacagccctcaggaggtcctgagaacacgtgcccagtttgtttggggtgcaacttggcgttatacattttagggagatatgaaacttcaatcaaatacatttaagaaatacattggttttgtccagaaaagtgggacaatgtgaagtgtggtggggtgggagcagggggcttccagcttataggtagatttaaaatttttcctggttgacaactggttgagtttatctaaagacctgggatcaacagaagggaatgtctgggttaagataaaggattatggagaccaaagttcttgtttgcagaggaagccttcagatggtaggcttcagagagaatagtttgtaaaacgtttcttatcagccttaaagtctgtgttgctgtgaatgctgaagaggtataagggggtatgtctgactctcactttccatcatggcctgaaacagcctctcaggttaaatttttaaaagagccctggctgaggaggaagtccattcagatggttggggggccttagaatttaatttttggtttacaccctattcaacagagaaagaatctcatggtcagagccgtcagcaatcattagtatctaactagaatttagtaactttttgctttcattggatttatttttatacttaacctttatttagaaagctacactctttctgctcttgtaatgatgtaaaatttattttttcttaatttaagcaaaaaagctgatttgtagaaagatagtgatacattaaaaggctaaaactttcacagtgttagattaatgcttgaagtttgggagacactatgctatttataaaaatcatcacgggaggaaattccagatcttcccactttgtctttcatgatctgaaaacttgttgggaactactgggtatcaaggaggctaagtccctgggccacttcttggttctatttttattctcatagtttccacaaatttgactttctttgaagttattttgctctccctcctcttctatatctggaatcctcttgtcccaggaataaaactgaacaccatttccaagtatttctctcaagttactatttataaagtaagtactgtatacaaacccagtttccttgttagagatgttttgctttgttggattaatcatggtagaacagagagtagttaaaaaatgacgatcaataatcaggacagatttggagccaggaaatactttgagcaacaacacagtagttgttcccctggtttctcactgaagagtgaatggggatggctccactccatactttgaatttcttcttgaattttcccagccctagcccaatttttgccttagattctaaggcgtaggataaatcgggccaaaccaaatcaagagtcattgcttgcaaagccatttagactttatctgaagtagttagagcagaattccctgggataaccagttcagtccaaagcctacttggttatctgtttttttccctggaggaggaatgcactgtcttttctggctctcctggaccagaagcactggtttccctttgcctctttggaaggacttagagcttagaggtccagccttttccctacccttttctcctgctgattttgccctcagcatagccaagaagcccaaagttatgactaattctatctttaggtggacctggacatctcatcagcgtcacttcaaggttcactgatcctaaaggactgtttcttgttggaaggtcatctcagggtgggtatctatttgtgaccagagctgatatggagtccagcctttctgagttactagccctgggctccttaaaatctccattcacttcctcttcccttccttacaggagaggacttacagatgacagtctctagagtcttgccgtcttttgccagaatacattttttaaaattgtgaaaatagcaactataatttcaccaaggaccattcctttacgttattactgaatttagaaaattctatctcatctaatctgagcaccttgatccctttagagtaaagtcattttataaaatctaaaaagtagatccaagtaataaattgattttcttgcaatttaaatacatttcctctgattctaccttcactggaaggggagaatagctgctgacctcactccttttcatgtgctgaaagaccattattaagcatctttcatcttctggattttgaggctagggagcactaattcttcagctttttttctccaaccatttagaaattttggttctctttagacaaaaatttttaatattatttctaaacctggagtctagatgtatatctagtatactaataatggtttctttggtgctggttaagacagaagaattgcttcttagttcttgtgaatgcactcctatttgcttaatgctgaattattcagttcctgttccaaaattaacctgccacaaggcacaggtaagcctgatcatcgtgaatctcggtaccctttagaaatattagcctcttctcattctactgtgattctgtatttttttttttacattttattaactttttaatgtcattttgaattctgattctgaaatttggaaattaaaactagtgaccttaatgcatgtctaaaaactatggagaaaaagaaaatttacaagaatagtgatttttcaggtattgtgcaactataagattacagtaatgtgggcaactggcttttgtaataagtggaaaaaaaagagacagtaaacatattcctgttttcttacaagtgtaaccatcatggacaatagcagaaagcactagatgcccttatccactgaattattataaagggctgggggctgggcgcagtggcccgtgcctgtaatcacagcactttgggaggccaaggtgggtggatcacttgaggtcaggagttcaggaccagcctggccaacgtgatgaaacctcgtctctactaaaaattacaaaaattagctgggcgtggtggcacatgcctgtaatcccagctacttgggagctgaggcaggagaatcatttgaacccaggaggcggaggttgcagtgagctgagatcacaccactgcactccagcctgggtgacagagtgagacgccattcaaaaaaaaaaaaaaaaaaaaagggatctcccaaaatgacagagtgactctgtgtgatgagctcctcaaactccagtgtccttaccaataccaagcagcatctgtcacataatccgggagattctccaggtggtcaggggacaagagggagctgggaggtggaggaactgcaaatctcctttccctgcatgctctttgtgttccctacaagcagcaccactgaagggcagtggtgggactcatgctctcctgccaccagccgccacctccctattgtgtcccactcagagttacttgacaaggagcaatttagacagttacacgtctttataaaaagattaactccagcaacctctcatccccaagccttttctgagcatattaacctgttgctctgatcccagtcagtgtaatcatccaaaagaccgcccagggtccaaagtcagaagaccaaggccgggtcatccattcagagtgcaaatggctcatggcagtgtacagcccactggttcaggatgagtcacctaaacaagaagagaaaaaatcagaagcaaacagaaaacctgcaagaagcaaacttcctttgaattgctttgtctgtttttatttagaaaaagatctactgtgaacctggcattagaaatggctcatgaggttttccttaggagaatgtttcatattttctgaacaaagttgttgcaagcaaagttgcatattgtgttcgttggacacggtcaaatagagaaatattcataaaaagttttaggccagaagtctcccaagtgatgtgcccacattgaaggaatacactaagtaatccactgtgagggtgaggaaaatattggagcatctgtttatacttattcttaaaatcctatcctttaattaaaaaaaattttttttgagacagagccttgctctgttgcccaggctggagtgcagtggtgcgatcttggctcactgcagcctccgcctcctgggttcaagcgattcttctgcctcagcctcctgagtagctgggactacaggcacgcaccaccatgctcagttaatttttgtatttgtaatagagtcagggtttcaccatattgtccaggctggtcttgaactcctgacctcaagtgatccacctgcctcggcctcccaaactgctaggattacaggtgtgagccaccgctcctggccttaaatttttttaaaaaaattttatttttttatagagatgaggtctcactgtgttgcccaggctggtctcaaactcctggctcaaatgatccttctgtctctgcctcccaaaggcccgggattacaggtgtgaaccagcttcctgatcccccatcctttaatttttatgatgtttgttttataatgaatatgatattcttttccagttgaatgtattagctgtgctaatggataaatcccagattctccatggtttaacacagtggaagttcatgtcttgctcaagtctggtcctatgtgggagctcctgggtgtgggcctcctctgctgcaggaggatgtgtgcatatttttatggggctgtgcaactgttagagctatgcaatcagaaaagtttggagactagtgttgaaggaactgccacatttggagctgccaggccacagtttgattctttttcccacccccaaataacataaactttgtagtatacttattgactgagacaaggcccaaatagcacttagtttgggccatccttactgctcctggttaccagatccaggtgggaatgtgcagtagtcctgagcccccagggcccaggctccatggtactgggatgaacaacaaggggtctcagcagctttaactactcaatctccacagtgcccaccagactctttccagttcttctgggtcttacccagttttagcacttaaagctccatgtccccctaaattcctcagtcccaggcaaaccaagatagcgttcatgggaagcttcaatatcaaaggagcaggggattgttcaaagagggctctcgccagggaatgagtatacacagcctgttttcccatggacagcctgtttttccagtatggacatgcagagaggagacagtggtcataatcaactctaccccctgttctcacaggaagggaagattgacagctactgcaggctgtttgctgttccatttgggaaattttcctgaggatcccctgtaataagaggatagaatatatctgccttcatgacttaaaagaggctataaattattttcatgtcaatgaaactgtaattagccactgacaggattgtcaagaagtaattttcagagtttggtccccttgagttaaacatgcctgctgacagcttactgaggacgtgttattgtgggacaccatccaggcctggagggacccagaatcaggcagaaggacatggtcacatggtggaggggctggaggaggtgacaattagcaggtagaatgggattccaggtatttcaaggccaaaccaatacttggtgctttcaccaggcaggcagcagggaagactgtcagcaacaaacagggcaccccactggcagtcagatgatgatgatgatgatgatgatgattattattattattattattatttgagacggaatctcactctgtcacccaggctggagtgcagtggcgtgatctcggctcactgcaagctccgcctcctgggctcacaccattctcctgccttagtctcccgagtaactgggactacaggcacccgccaccacgcccggctaattttttatattttttaagtagagacggggtttcaccgtgttagccaggacggtctcgatctcctgacctcgtgatttgcccacctcggcctcccaaagtgctgggattacaggcatgagccactgcgcccagcaattattttcaatctctgagagatgatagcaagaaatgggcaaagtctcatttccaagggactaaggcttgaggcaggtcagcaaaagagggaccagggtgaaagtacaatgagcacagctgggacgtgaggttggggtgagctcagcagtgaccagccacttgtaggggacaaagggcctatttcttgagaaagaaaggtacagagatatggtgctgagctgctccagtactccaggtgttgccatcctgtgagcacaaacgcagctgcaatcacatccttgcctaaatctcagtggcttccagccacctgctgctcacccaggatcccagcaccccggttccccatcttcccaattccttctgggaatacaggggatgtgcccagggacacagctcctgctggcaagcagctgaagcaaggggctatgccactgtcctgctccccagtcctctgtgagtacaataccctccccaggttctggagtgccttccaccaccaccaggagctgctctgggtctgtggcagagggagattaagggtgtgactctccccgactttgtctcttctgtcatctgaggcatggcaccacttgtatctggaatctcaccaagtttttcatgaggacgatccgtcagcatctgttctggtctctggtttcccattaggtgtgaaactagttccctagcttgtgagggcagcaggggaactccaaaacatcccctctatttttatttcctttctccttgctcaaaggccttcttcctctttcagataagagacacaaaagcacacatgcctatcaatttatgtggacagacacccaaagggcttctgccctctgcagtgcagtttggacttaggacattcttacacaatattatctctttgtccccagatgccaagccaaggccactagaaaaacctctaaataattagacttttatgaaggctaacctgggctatttttgaaggtgcttttaaaacaatcttatcacacctaattttgaataaagatatgttgtggaaaaacttgatgcttacatttggaataatttaaggtgtattacaaaacaataaatgatgggacaattgtgttatgtttccaaaaaagttcatataaaatttcagtgagtgggctgggcgcggtggctcacgcctgtaatcccagcactttgggaggccgaggtgggcggatcacgaggtcaggagatcgagaccacgatgaaaccccgtctctactaaaaatacaaaaaattagccgggcgcggtggcaggtgcctgtagtcccagctactcgggaggctggggcaggagaatggcgtgaacccaggaggcggagcttgtagtgagccgagatcgtgccactgcactccagcctgggcgacagagcaagactacgtctcaaaaaaaaaaaaaaaaaaaagaaattttcagtgagtgtggaaggactagagccttcctctgctactactacattttacctcgtgggaaacaggcctatggatttagccaaggaaaaagaaacgtgggaatgctgtttattccttgcatagccgtaatataaagtatgaattttatcaagtatcttttcactcaacctatcatagccactcaaaaagatgttaatggaaagacaaccatcagaagcaaaatcatgccaagaacgagaagcagcaggaggaaaaactttggttacttctgtgagttctagaaagttgtagttacggtttgcaagagtatcagtgttaggctttagacaagacattccttgggtcaccagtggccttttgggtggtaatggccacagtccaaaaaggaagaagaaagcaattttgcattcatattatccatttccaattttttaggggactgatggtcactctcctggcccttagagatgtgtgtgggtaacctcgctggtgtctttgctggtggggttaaaattttccatacgtgcttcaggactctacctcagccatgtctttctgtgagcattgagcttgttaatgatgcatgtttcttacccagctttaaaagatgattgagttattactggggagttattattggggagttttttcccatgtagttgaggcataagttgataaggttgagctgacctagacgcagttttctgtgggattatggagaatgagggaagaattacgctttgtaattatgcttttttttttttttaaattcagagaaaaaagatcacttatggtgacccaggctaaaagacctaggtcttcaacaaccagcgtcatctatttctagatcaattgccttgtaatattaagtatttaagctttgaggcttactgaaggaaagatatggggtcatttacaatcctgtagactatgaccttccaccaggatctactcaagacctcatcacacattatgttaaattctttctggtggtgaaattgtcagcaaagagctcggccaacctaaccaagatcacttggagttataccttaggagggaggatgaatataagtcatctttttcccctttgttagatgcagatgaattaattatagttcccagagaactattcccttttgcttaaattagtgtcagattttccatccacgtcttctatgaatagaggcaatatgacttgacattaggacagagctttggaatctagagatggatgctgtctatctttgattctctgcaatgcatgtcagtctgggctctcaggccttagtttcttcctccataaaatgggaatgaaatatgctcactgatttacttcaggagattttaagggaattatttaaagaccattttgtaatgttctgggtaactcaagtggaaggcaatggatgtgagggaatttttaaaataagaaatctcttgaatatgaattgagtaatctcttaagttctttagataagatatggagtgatctttaggctcaggaggcctgtcttttgggaaagtgctataactcacttctactaccggcaacttaatacgtaagagaatattcttggccctgctctgaggtttaaacaatgttcaaccttgaaagattgattttaaatgtaaaggtcatttaaactcttttgtaagttcttatattttgttaaaataggctgaacatttacctctagatgaaaaatcaatgcttcagtgtatacttttctcataaaataacctatgtctttatttttttctgcagacaaaactgtgtggagttttatcctatattcataattacattgtggatggctgggtggtatttcaaycaaggtaatgttaaaatacagtcaactgtgttctaatgatgactatgatgcttaaacgattaaggagtagatatatggccaggcacggtggctcacacctatattcccagcactttgggaggcccaggtgggtggatcacctgaggtcaggagttcgagaccagcctggccaaaatggtgaaaccctgtctctactaaaaatacaaaaattagctaagtgtggtggcgcatgcctgtaatcccagctacttgggaggctgagacaggagaatcacttgaacccaggaggtggaggctgcagtgagctgagatcgtgccactacactccagtctgggtgacagagactccatctcaaaaaaacaaacaaaaaaaggagcagatatgcaactatatagctaccaatcctggagactaaacaaaataaacagtgtgtgcatcagagtgctatgttgcaggtatatgaactttggcttcattctaatttaattcaataatgaaaaaaatattgagacaaactatatgctagatactgaagaatgagaacgacatgagctttgtcttcaaatctaataatctacagttgactcgaacaatggaggggttggggtgctgaccccccgccccacacacacacagtagaaaatctgcatgtaacttgataacccaaaacttgactactgatatcctattggtctggaagccttactgagtacagtctactaataaatattttgcatgttttatgtatcatatactgtattcttgcaataaagcaagctagggaaaagaaaatgttattaaaattataagtaagaacaaatatttactatttattaagtggaagtggaccatcataaaggtcttcatcctcatcattttcacgttgagtaagctgaggaagaggaagaagaggggttggttttgctgcctcaagggtggcagagtcagaaaaggtgaaggaggtggaagcggagacagaattggcaggcgcagtaggtataaatttatagaaatatcatttctgacgtttttgctttttttctctaaaaatgtttctatatagtaccaatccttcttccactgttacgtttagtttcagtgcttgtatcatagaagggtccatgtcataaaagaagtaaaaaagcagacttgaatcatcagaacccttctgccagattgtctaatgtcaatttgttttctggtactgcctcttctgtcttcttccttatcatctggcagtggttcagagcactcgtctctaccaagtcatcttctgttaattcatctggcgtggtgtctattagctcttgaatttctccaagattcatatcttgagacccttcatcccccacattctttgccacagccactatctctttcatgatttccttgattggctctgttgtaaatcctgtgagtgtcatgcacaacgcctgtacacagtgttcttcagcaagaatttattgtttcaggtttgacggctttcacaaccttcctataacaatgctagcatcttcaatggtgtaatccttctaggcattcataatgctgtttctatcagggttctcttccacaacattgacgatcatatccatagagtaccttgtatcatgagccttaaaggtcctgataaccccctgatttagaggctgaattaaagatgttgtgtttgggggcaagtagactacttttatgccttccacgttgaactcatggggttctgggtggtcagggacagtgtccaatatcaaaagaatgttagaaggtaatcccgtcctgacttcagggacaaagcattgatggaaccaatccagagaaggggttcttgttgtccaagctttttttttgtacaaccaaatgactggcaggtgctgtttatctttttccttaaggctcagggggttagcaactttatagataagggcagtcctgattataaacctgactgcatttacacaaaacagtagagttagcctatcccttcctgccttaaatcctggagcttgcttctcttctttactaataaatgtcctttgtgactttttttttctcccccgggacagggcacttttgtttgcattaaaaacctgttcaggcagatatcctttctcctcaatgattttcttaatggtgcctgggaactcatgtattgcttcttggttggtagaagctgcttctcctgttatcttgatattttaaaagctaaacttctttctaaaattatcaaaccatcctttgctggcattaaattcttcagctttagatccttcatcttccttttgcttaaagttgtcatacaaggattttgctttttctcgaatcctattagagtctacaagtatgtgtttcttttttcttttaatagtttaatgtattttaatagcaaacttacaggaacagcacagaagacagacaacattaaaaacatgtacttgcatgtaggacaactcagttagaaaagtatagtgaatggatggaatctactgtatgataaaaatgctacaagcaccatttagttgccatcaataagaaatttacttgttttaaaaaaatccaaatgctggcattgtccagaaaaatttaacaggtttatttataattattataaagttgaaccgctgaaacttgttcactgaaacattttaacttgcattaacgctttacgtctccgcatttatattaaaaattcacacacaaatgaaaatggaaaaactgccaatacctgatttctgtcccctatttttccactcgcaatcatatacttaggtaccttttgaccccatggaaaaaaattatctaacgttcagaactaccaataacaggaagaagagaaattttttttttttttgagaatgaaatgtttcccatcatagtggattcttaagcacgttctccacgtatgctgtgtgctagctggatgtcttttggcataattgttacacgtttggcatggatagcacacaggttggtgtcttcaaaaaggccaaccagataggcctcacttgcctcctgcaaagcaccgatagctgcgctctggaagcgcagatctgttttaaagtcctgagcaatttctcgcaccagacgctggaagggaagtttgcgaaccagaagttcagtggacttctgataacgtctaatttcacggagcgccacagtaccaggcctgtaacgatgaggtttcttcacccctccagtagagggcgcactcttgcgagcggcttttgtagccagttgcttcctgggtgctttaccaccggtcgatttgcgggcagtctgctttgtacgagccatggtacagagacctccttacttaccccccttctccttcggctggagctcggcgagcgagaggcggcgctggcgttggagagccaagtatgtgtttcttatagcaatcctgctcccacataaaagctgcatttcaatatgagataaaaagacattttggaaaaagtgcaaggtttttccccctgctggtgtagctgcaagtgacagctttacaaatcactttttctttcttttttcttttcttatcttttcctttcttctttcttcatcttctttttttttttttccactggtccttgcactgaattcatttatcttgcaatggtggtcaaccacagctcacagctgcagacctcaatctatgacacatattaagccattcaattttttcttgtaatatcataacttttctctgctttttgggagcactttcagcaccactagtagcaatctgtatgggtatcatggcattattcaaggtttatggtattgcactaaacattgatgaaaaataggcaaaaaccctgagagatcactttttactgcgatacgcaattttctggaaagaagaactgctcagttggagataattagcatcaccttttaagcagatacttgcaacacttgagctcactgcaatagcaacaggaggtggctacaaaatatttacagtagtacagtatttctatagttaattttatgcagttatgatttaatactgcatctttacacttgtttacatttctctcaactacaagtggcatcatgcattatggtctgtgtttgtatgctttgataaattttaactttgcataaaattcatatatatatctatatagtctttctgctgaagctttgtaaaaatttgcgtatattttatgatagtaaatgataaaatagaccagtatctacatctgttttgtgcatttgtgacagacctttttcctaatttttcagtatttctgggctatgtgattcatttgtgagttttgtcacattgtcacaaatctccaaaatgttttccaatatatttatgtttatttttgtaaagccacctcctgcacaatccaatatatttatttgaaaatatccatgcataaatggacctgtgcagttcaaacccatgttgttcaagggtcacctataattctaattaactgaaggaggaggacacagaatgaaaaattcacattaataattatagctggcgaggcccagaagcttatgcctgtaatcccagcaatttgggaggctaaggtggagggattgcttgaggccagaaattcacgaccagcctgggcaacaaaggagaccctgtgtctacaaaattttttttaaaaaactatctgggcacacatgtagtcccagctacttgggaggctgaggtgagaggagctctcaagcccaagagtttcaggctgcagtgaatcatgacagtgccactgcactccagcatgggtgacagagtgagaccctgtctcaaaaagaaaataataataattatcattatagctattatttattgagcccttactatgtgccaggtactgtttttgttttttggtctttggttttgcttttttttttttttttttttgagatggagtctcgctttgttgcccaggctggagtgcagtggtgcgatctcggctcactgcaagctccgcctcccgggttcacgccattctcctgcctcagcctccggagtagctgggactataggtgcctgccaccacgcccagctaatttttcgtatttttagtagagatgcggtttcactgtgttagccaggatggtctcgatctcctgatctcgtgatccgccagtctcggcctcccaaagtgctgggattacaggcgtgagccaccacgcccggccaccaggtactgtttttaagttttatgcatacattgtcccatgtgtaagatttacaggatttaaagccttcatatgagggagggtctataattaatttatactttacagatgaggaagctgaggtacagagatgttaagtaatttttccaacttgacattcaccaatgtggggaaatttttcctttcaagtgcagagccgggtctgtaagtatttgtaccaacaacccatgcaccttttcttaaaggtctccaagtatgtagtgctgccgtttgtatgtagcgactctacaaacatccactttctatttgactggggtatccttggtgagctgagggctttctccaaacttggcttatgcgtttaacagtgagtcagaccagcccctgctaccttcgttggagaaattcaatctcctttttctggtaactttcactgtctcattttggtctatacttgattgccaagatttaaataaaccaaaatccagctgctttcaaaggcaaccccatcactctctttcttttagtttttactgtgaactgagtaatttcaggtacaatgtcctttagagaaagacttcttcactttattacaactatacttgtgtcgcttaagggcatgaatgaaaccgctgttccttgtcacgtaagagcacgttaacaactaataagaaaagcgccttttggtaatgggactctgtctctgccatttgaccctttggatttctctgtgataggctgaatgaggcagactgcctgtcagaaaggattgcttgagtatcttgtcagaaatttcttttcattctttctcatccaaagtaagtcacctactaactgttcctgaactgttctcattggctttctgggagtaactccctagacagggagtctcaaaactgagaaccatgttcagaactctttggcttcctcagaccctgggaagggtccaccagctcttccttcccagctctttgcttggtccgctcgttcctgtcctgtggtgccgatacagatgtcatcccctccagaggccttcctataccccattttggcaacctcctccagttcctctctctcccatctctcttcatttctttcacagcactttcaagtttgcacttttcttctcatttttttctttgttgtctgtctttgctgagagaatgtatactctctgaagtcagggagcttgtatctttttcactgccgacctcaatccttaaagtaatacctggtttatggtagatacggggctgggtgtggtggctcacacctgcaatcccagcactttgggaggccaagacaggaggatggcttgagtccaggagttcaagaccagcctaggcaacatagggaggccttttctctgaaaaaaaaaattaaaaaattggccaggcctggtggcatacaccagtggtcccagctacttaggaggctgaggtgggaggattgcttgagcccaggaggttaaagctgtgctgagctgtgatcatgccacacattcctgcctgggtgacagagcaagaccctgtctcaagaaaaaaaaaaaaatcatgcggccaagtaaaataataaatttaatttaatctagcatatcgcagtcccacacatagactccaaatgtttacagtagggctctggcaacttgcatctgtgaggtgctgaggaagagagtggggccctaacatagggaagacattgatatgtattgatatgtttcactggatgcgatgatagaacatcatcatactgtatttcataattctttttgagataaattttgtatgtaataaaatgcataaatcttcaatgaatgttgagaagtacacacacctgtgtggtccagatctctatcaagatctagaacatgacaaccacccagaaagtgtcctcctgcttctcccagtcagtccccattctcactcccagatgcaagcacttctgattgttttcatcagttaggtttgtccattctagaacttcgtataattggaatcatacagtatgtagcctgtataatgcttcattcactcagcaaaatgttgtgttgcatagatctgttttttttcattgcaaaatgttgtgttgcatagatctgtttcttttaattgaatagactctatcacagcttggttatccattctcctgttgataggcttctggactgtttccagtttttgtctataatgaataaatctgcaatgaacattcttaaacaagtccttttgtgaacacatgctttcatttctcttgggtaaatacataggaatgagattgctgagtcaaatgttacgttcgattttataagaaactaccagaacttttcccaaagtggctgtactattttgcattcctgccaatgatgtgtgtggattccagttgcttcacatcctcaccaacattttgtgttactggtttttttttttttttttttttttttttttacaattttagccattctgttggatgtgtggtggtgccatctcattatagttttttatttatttatttatttttcagatggagtctcaatttgtcacccaggctggagttcagtggcatgatcttggctcactgcaacctccacctcctgggttcaaacgattctcctgcctcagcttcctgagtagctgggactgcaggtgcccgccaccatgcccagctaatttttgtatttttagtagagacgaggtttcacaatgttggccaggctggtcttgaactcctgacctcaagtgattcaccccccctcggcctctcaaagtgttgggaatacaggcctgagctaccacgtccagcctcattatagatttaagtgggaatttgttgatgttgaatcatgttgaaacatttttcttgagattattggcacatttgtttccttcctatgtggattctctctatattctgaatataagtatcttgtccaatatatgttttgtgaatattttctcagtcgtcgtacaacatcttaagagactgctgttgtattttgtgccttttctttttttttcccacccccctatagtttttgctacttgtctgggtctggtgtacatatatggccgtcacctayacttctggggatattcagaagctgctaaaaaacggtaaggagaacccagtaattttgtatttatgcaaaaagtagcaggataaggtctgggtcagtttccttctcctgagagatattaacagcactgtgagttgtggtggcaaaagtaatccatactgtctgaggtcaagtcttgccagttcatacacaattaggcatgagatgggaaaatgcaagtataaaactgtgcactgaatgtggactctagttccttgcaaaaattttgcattgtctccagaaagttaccgaggaaataatcctgcctagccttgataatgctttgaatgttcaaagaaaccaagtgatctctatggctaggcattccctttaacttatgtgatgagctaaaattttcaaattgcaaaaatatagaagttctggacagtgttaacgataggacagcctacctcaggactctcagcttccttattacagtccagtttgtcacttttctccctcatgtccactctgcaggatcaccggtttcygactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaatggctttgtagaaacacacactttagagaatacatttcctgtttaagaactgaaatttgcttgrggtaggtacatccatatcatcagtggaagtgtgttgtgccctagttttagaaatgcatgctgaagtcatgaccggttgtgtagggacacagcagcctgacccgtgtgctggccgttccgaggactactgacatatcctgccactctgactgcttctctcttgatggaaagtttcagacagaagctgataaagcagctgagccctttcattggttataggaaaacaacagataggaaggcatgtgggggacatcaggcaaacacatagagtagccagagaagggagtcatcaactgatagcacaaaacaaaacaggttatagaaggctgggcgtggtggctcatgcctgtaatcccagcactttgagaagccgaggcgggcagatcacaaggtcaggagatcgagaccatcctggctaacacagtgaaaccctgtctctactaaagatacaaaaaattagccgggcatggtggcgggtgcctgtagtcctagctactcgggaggctgaggcaggagaatggtgtgaacctgggaggcggagcttgcagtgagccaagatcgcgccactgcactccagcctgggtgacagactctgtctcaaaccaacaaaaaacccaaagaaaaacaaaaacaggttataaaaatgtactttataaagaaaaaagtgtttccaggccaaaagagcttgctgcctgatgcccatactgtaaaaccaggtttttgggaaaagaaagaaatttaattttaaaaaagagacggtcttgctgtcacccaggccggagcctccaacacatgggctcaagcgagcctcctgcttcagcctcccaaagtgctgggattcaggtgtgagccactctgcccggccaacaaaagctttatattgcaagtcaactcacaggaagataggagtcaagctcaaatctgtctccctctgctggcttccaagcagtatttttattagaaaatgtcagggggtaaattctgagattagtaggtgattggtggaaagaaaggggaggtctgaaaagtccttgggcatgtccagttatctctttatgctgcctcagaggtagcatgtgcaaattccagaggagttagtatgaaatgtcatggaaattcaggctgtgacatcagcaagcttgttctgtgcagactccagttagccatcttggttccaacaaatttcagccagtttttttttaatctcataaggagagagagtttcagtgtttcagtaagttatttcttttcttatctgccatcctccaaattcaagaatttcctttagttattggtttcttgaactctttggggcacaatttcaagaggaagaagtaaaaaaaaggataccatttcaaggaattgcccagggacaagtgcgaagagaatattctttctcttggctgaggaaggtgggtcatgctcacggctgtagaacgtgggttgggttctgctgcatgccctgtgtcatgtggggtttggagggtgatacgggaagtacagcggaacccccaaagctgttctgaccctgaagtgcagttattgtctggcaaaatgcagatgacttttcctcattttcttcatctgtaaaatgagaacgattctacctcacagctttcaaataaaaggcaaaatgaattatgagcatacataacacattttgacgtcaggaaaagggcttgagtctggtgtgggcatcttcaaaaattgtttagtagtacttttctttttttgtggatacaatagaagttaaaaaggccgggaaaaatattaatagaaaaagaaagagagacacttaaatactagtgttcccataatacataacctcctgcatcccaaatagcagtacagtattaaataccccaaagcacactgagaatatactggcctgggagtgggcacatttgcatactagctcaggttcccctactcattggtcatttgaatttggacaaggcaccccatcagtaggaggttgtgaatcaaagaagtgaagactccagaaccagaccaccctatcctgtcctatcacttgctggctgtgctaccccagcactttgtagctctctgccttggttttcttttaggtaaaatagggcaaatatgctaaaaagctatgattctatggtctttttacttaatattcttttcagttatgatcgtgacttggattgtgacattttaattgttttatacattgagaccaatgaaggatgagaatgcaaatttttgatactaaggcataattacttcataaccatgtcctttgcaagttgaaaagaaactttccaaatcttacaactgaagatttttaagcaatttctgttttgcacttaaattggctctgggcagggtaaaacacacacatacacacacacacacacactttggttaaacacgtggaaataagctatgggtgtagcagactatcaaggccttgtcactttaaacattcaaacgatagattttcctttgttctaattgcattgtcaccaggcaaccttttgattattttcattcctattagatttggctacagagagcaaccatttctggccacagagatgtgggtttctgatcggtttgacaattacatgtacattttttgtatattactaaattgatcaattttatttttagaaatcagattcattgccttaaaaagtcagtgtcaggaagtgggggatagagaagaacttttctgcattaagagtcttttttaaatttttttatttttattttattattattatactttaagttttagggtacatgtgcacaatgtgcaggtttgttacatatgtatacatgtgccatgttggtgtgctgcacccattaactcgtcatttagcattaggtatatctcctaatgctatacctcccccctctccccaccccacaacagtccccggagtgtgatgttccccttcctgtgtccatgtgttctcattgttcaattcccacctatgagtgagaacatgaggtgtttggttttttgtccttgtgatagtttgctgagaatgatggtttccagtttcatccatgtccctacaaaggacatgaactcttcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcaagcagcatgatttataatcctttgggtatatacccagtaatgggatggctgggtcaaatggtat

SEQ ID NO: 486 - DNA, 750 bp, Homo sapiens
  5'UTR 1..201
  CDS 202..645
  3'UTR 646..750
  polyA_signal 721..726
  allele 98: 10-286-289  : polymorphic base G or C
  allele 153: 10-286-345  : polymorphic base A or T
  allele 183: 10-286-375  : polymorphic base A or G
  allele 426: 10-523-232  : polymorphic base C or T
  allele 478: 10-289-201  : polymorphic base C or T
  allele 526: 10-290-37  : polymorphic base C or T
  misc_feature 57: n=a, g, c or t
ataaagatctgtgaccggcagccccagacctgcctgccttcctgacttctgttccanagcaaaggtcattcagccgcttgaatcagccttttcccccsacccggtccccaactttgtttacccgataaggaaggtcagcattcaaagtcaagwagcgccatttatcttcccgtgcgctctacraatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacaacaaaactgtgtggagttttatcctatattcataattacattgtggatggctgggtggtatttcaaycaagtttttgctacttgtctgggtctggtgtacatatatggccgtcacctayacttctggggatattcagaagctgctaaaaaacggatcaccggtttcygactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaa

SEQ ID NO: 487 - DNA, 650 bp, Homo sapiens
  5'UTR 1..201
  CDS 202..294
  3'UTR 295..650
  polyA_signal 621..626
  allele 98: 10-286-289  : polymorphic base G or C
  allele 153: 10-286-345  : polymorphic base A or T
  allele 183: 10-286-375  : polymorphic base A or G
  allele 326: 10-523-232  : polymorphic base C or T
  allele 378: 10-289-201  : polymorphic base C or T
  allele 426: 10-290-37  : polymorphic base C or T
  misc_feature 57: n=a, g, c or t
ataaagatctgtgaccggcagccccagacctgcctgccttcctgacttctgttccanagcaaaggtcattcagccgcttgaatcagccttttcccccsacccggtccccaactttgtttacccgataaggaaggtcagcattcaaagtcaagwagcgccatttatcttcccgtgcgctctacraatagttccgtgagaaagatggccgggaactcgatcctgctggctgctgtctctattctctcggcctgtcagcaaaacaaaactgtgtggagttttatcctatattcataattacattgtggatggctgggtggtatttcaaycaagtttttgctacttgtctgggtctggtgtacatatatggccgtcacctayacttctggggatattcagaagctgctaaaaaacggatcaccggtttcygactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaa

SEQ ID NO: 488 - protein, 147 aa, Homo sapiens
  VARIANT 93: Xaa=Tyr or His
  VARIANT 109: Xaa=Arg or Stop
MAGNSILLAAVSILSACQQSYFALQVGKARLKYKVTPPAVTGSPEFERVFRAQQNCVEFYPIFIITLWMAGWYFNQVFATCLGLVYIYGRHLXFWGYSEAAKKRITGFXLSLGILALLTLLGALGIANSFLDEYLDLNIAKKLRRQF

SEQ ID NO: 489 - protein, 30 aa, Homo sapiens
MAGNSILLAAVSILSACQQNKTVWSFILYS

SEQ ID NO: 490 - DNA, 357 bp, Homo sapiens
ataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaratacaaagttacgcccccagcagtcactgggtcaccagagtttgagagagtatttcgggca

SEQ ID NO: 491 - DNA, 274 bp, Homo sapiens
ccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaaacaaaactgtgtggagttttatcctatattcataattacattgtggatggctgggtggtatttcaaccaagtttttgctacttgtctgggtctggtgtacatatatggccgtcacttggg

SEQ ID NO: 492 - DNA, 18 bp, Artificial Sequence
  sequencing oligonucleotide PrimerPU
tgtaaaacgacggccagt

SEQ ID NO: 493 - DNA, 18 bp, Artificial Sequence
  sequencing oligonucleotide PrimerRP
caggaaacagctatgacc

SEQ ID NO: 494 - DNA, 47 bp, Homo Sapiens
  allele 24: 12-421-140 : polymorphic base A or G
ttggtttggagccagcatgtcccrcacctcaaaattaatgtttattt

SEQ ID NO: 495 - DNA, 47 bp, Homo Sapiens
  allele 24: 12-424-192 : polymorphic base A or G
  misc_feature 44: n=a, g, c or t
gttctgagggctcaggaacagttrcatgaggtccagagttcgantta

SEQ ID NO: 496 - DNA, 47 bp, Homo Sapiens
  allele 24: 12-424-198 : polymorphic base G or T
  misc_feature 38: n=a, g, c or t
agggctcaggaacagttgcatgakgtccagagttcganttatgaagc

SEQ ID NO: 497 - DNA, 47 bp, Homo Sapiens
  allele 24: 12-425-57 : polymorphic base G or A
gcaggtaggagccatcatccccaragttttcttgtacctgctgggca

SEQ ID NO: 498 - DNA, 47 bp, Homo Sapiens
  allele 24: 12-426-154 : polymorphic base A or G
caatggctttcagactgtaaactrcagctcacagttcatgatctagg

SEQ ID NO: 499 - DNA, 47 bp, Homo Sapiens
  allele 24: 12-429-198 : polymorphic base C or T
attgataatgtaaatcatctaggyctgaatgcctaaagtgatgggga

SEQ ID NO: 500 - DNA, 47 bp, Homo Sapiens
  allele 24: 12-430-80 : polymorphic base T or C
taaaagagaattgaggacaaaatyggatttacaaaaagaggaaacaa

SEQ ID NO: 501 - DNA, 47 bp, Homo Sapiens
  allele 24: 12-433-215 : polymorphic base A or G
gcagagccaaggtagagtgcatgrttgaaaattcaggagacaggatg

SEQ ID NO: 502 - DNA, 47 bp, Homo Sapiens
  allele 24: 12-441-233 : polymorphic base G or A
ccttttggaggacttgtggcttcrgtgtcgtcctaagtgagagtggc

SEQ ID NO: 503 - DNA, 47 bp, Homo Sapiens
  allele 24: 12-441-343 : polymorphic base G or A
gtcctcttccaaagtcctgtacarttgttctctgcaattgacgcaca

SEQ ID NO: 504 - DNA, 47 bp, Homo Sapiens
  allele 24: 12-442-221 : polymorphic base T or C
atgtggtctctgggcaagatggtygccctgagtaatagaaaagaaag

SEQ ID NO: 505 - DNA, 47 bp, Homo Sapiens
  allele 24: 12-447-58 : polymorphic base G or C
aaattcctggtcttctccgaagasggaattgagtggggaaaaaaaag

SEQ ID NO: 506 - DNA, 47 bp, Homo Sapiens
  allele 24: 12-453-429 : polymorphic base C or T
gaaatgttatccttcctaggagayaggatttatgggattcctggatc

SEQ ID NO: 507 - DNA, 47 bp, Homo Sapiens
  allele 24: 12-454-363 : polymorphic base A or G
acaagctgagtgacttacatagcrgaaaagtgttttcttacaggtta

SEQ ID NO: 508 - DNA, 47 bp, Homo Sapiens
  allele 24: 12-455-326 : polymorphic base T or C
agaatcttgcacagcaggctcttycttataggaggtgtgaggttgtc

SEQ ID NO: 509 - DNA, 47 bp, Homo Sapiens
  allele 24: 12-455-383 : polymorphic base G or A
aaggcctgaggctgtccacaagaratccccaggcggcttctgtgagg

SEQ ID NO: 510 - DNA, 47 bp, Homo Sapiens
  allele 24: 12-456-269 : polymorphic base A or G
gaaagagcaggaattcttctagcrggaattcttatatcaaatgcaat

SEQ ID NO: 511 - DNA, 47 bp, Homo Sapiens
  allele 24: 12-456-380 : polymorphic base G or T
  misc_feature 10,33: n=a, g, c or t
tactgtttgngggcaattcatctkggccaaatncctcaggagcaggg

SEQ ID NO: 512 - DNA, 47 bp, Homo Sapiens
  allele 24: 12-457-204 : polymorphic base A or G
ttaactatgccaagggtccccttrtcccccgaccaagagggccttca

SEQ ID NO: 513 - DNA, 47 bp, Homo Sapiens
  allele 24: 12-457-206 : polymorphic base C or T
aactatgccaagggtccccttgtyccccgaccaagagggccttcatg

SEQ ID NO: 514 - DNA, 47 bp, Homo Sapiens
  allele 24: 12-458-196 : polymorphic base T or A
ggtacttctccttatgtaaagatwgtggctgacgaccagcttcttag

SEQ ID NO: 515 - DNA, 47 bp, Homo Sapiens
  allele 24: 12-458-438 : polymorphic base T or C
gggcccgtgtcagcctgctctgcyggtttcccgactgctgaacctgt

SEQ ID NO: 516 - DNA, 47 bp, Homo Sapiens
  allele 24: 12-460-274 : polymorphic base A or G
gccctgaggtaggatagaacaaarcagtctcggcctcccaaagtgct

SEQ ID NO: 517 - DNA, 47 bp, Homo Sapiens
  allele 24: 12-461-124 : polymorphic base A or C
agattctcctttaatacagttgamagcagagaattagaaaccacctg

SEQ ID NO: 518 - DNA, 47 bp, Homo Sapiens
  allele 24: 12-461-299 : polymorphic base C or T
tttgttgttgttgttgttttctgyctttttaactatataggacaggg

SEQ ID NO: 519 - DNA, 47 bp, Homo Sapiens
  allele 24: 12-461-465 : polymorphic base C or T
tacttcttattgatcaaataaatyctgctttcttattatcattattt

SEQ ID NO: 520 - DNA, 47 bp, Homo Sapiens
  allele 21: 12-462-280 : deletion  ATGTCCCACAGCTG
gaggttaaggaacttgtctgatgtcccacagctggtggtggcgtctc

SEQ ID NO: 521 - DNA, 47 bp, Homo Sapiens
  allele 24: 12-464-66 : polymorphic base G or T
tccactcatagaggaccctctgckcattagcactccgatgagtggct

SEQ ID NO: 522 - DNA, 47 bp, Homo Sapiens
  allele 24: 12-465-26 : polymorphic base C or T
cctcccaaaccaactctttcccaytgggcagtcagcttgatctcttg

SEQ ID NO: 523 - DNA, 47 bp, Homo Sapiens
  allele 24: 12-465-234 : polymorphic base G or T
cgaggtggatgggggtggtagtgkgctgagcagagcagtgctgatgc

SEQ ID NO: 524 - DNA, 47 bp, Homo Sapiens
  allele 24: 10-428-219 : polymorphic base A or G
acaatactattccaaggagctggrgaggtatttgccttgtgtaatac

SEQ ID NO: 525 - DNA, 47 bp, Homo Sapiens
  allele 24: 10-429-84 : polymorphic base C or T
gaaatgtaacccttaataagataycatgtagaacaactttaaaattt

SEQ ID NO: 526 - DNA, 47 bp, Homo Sapiens
  allele 24: 10-420-284 : polymorphic base C or T
aaatcctctaagtttaccaagggyttaaaataccaagtgtgctcagc

SEQ ID NO: 527 - DNA, 47 bp, Homo Sapiens
  allele 24: 10-423-411 : polymorphic base C or T
ctgtagagcttaggagctacattygcttctcagagaagaatggaagt

SEQ ID NO: 528 - DNA, 47 bp, Homo Sapiens
  allele 24: 12-713-95 : polymorphic base C or T
tattcaggaacttacctttacccygctattgactgttttcacctaca

SEQ ID NO: 529 - DNA, 47 bp, Homo Sapiens
  allele 24: 12-713-149 : polymorphic base G or C
ccctttgtgatctggcccatgcasttcaccttcctgtctgccatcct

SEQ ID NO: 530 - DNA, 47 bp, Homo Sapiens
  allele 24: 12-716-295 : polymorphic base C or T
ttttatttacatcgaattggacayttacggtcagatagacagaaaat

SEQ ID NO: 531 - DNA, 47 bp, Homo Sapiens
  allele 24: 12-720-80 : polymorphic base G or C
taatgatgataactacaataaaasaagtacttactccatgacaggaa

SEQ ID NO: 532 - DNA, 47 bp, Homo Sapiens
  allele 24: 12-721-227 : polymorphic base C or T
atgcctacctactttctgtttgtytaactccaggctttcctgtaggt

SEQ ID NO: 533 - DNA, 47 bp, Homo Sapiens
  allele 24: 12-721-281 : polymorphic base A or C
tcaagccactgtgcactataaggmcttccagaactgctcttcctctg

SEQ ID NO: 534 - DNA, 46 bp, Homo Sapiens
  allele 24: 12-721-440 : polymorphic base A or G
taacacttttcttaagcttctccrtagtgttatgcttgttcagtgc

SEQ ID NO: 535 - DNA, 47 bp, Homo Sapiens
  allele 24: 12-723-293 : polymorphic base C or T
tggttatatatcatccttttcttytgtcactcctgaccttcagggga

SEQ ID NO: 536 - DNA, 47 bp, Homo Sapiens
  allele 24: 12-724-195 : polymorphic base C or T
agaagctttggctctaaaggactyatctgtgcttcaacataccactg

SEQ ID NO: 537 - DNA, 47 bp, Homo Sapiens
  allele 24: 12-724-225 : polymorphic base C or T
gcttcaacataccactgtattctyctatttctagtttgtaccattcc

SEQ ID NO: 538 - DNA, 47 bp, Homo Sapiens
  allele 24: 10-153-329 : polymorphic base G or T
ggagcctgggctaggtgtaggggkcctgagttccgggctttgctacc

SEQ ID NO: 539 - DNA, 47 bp, Homo Sapiens
  allele 24: 10-95-342 : polymorphic base A or G
aggccctggtgcggcagggcgacratttcaagggccggcctgacctc

SEQ ID NO: 540 - DNA, 47 bp, Homo Sapiens
  allele 24: 10-100-277 : polymorphic base C or T
ttgtccctgctaggaactgtttayataatgaaaggaggggacctcaa

SEQ ID NO: 541 - DNA, 47 bp, Homo Sapiens
  allele 24: 10-102-294 : polymorphic base C or T
gcgcggctgcgcttctccatcaaytgaagaagacaccaccattctga

SEQ ID NO: 542 - DNA, 47 bp, Homo Sapiens
  allele 24: 10-413-394 : polymorphic base A or G
cttagcctatctgcatggctgccragtgttgcagcactttcttcctt

SEQ ID NO: 543 - DNA, 47 bp, Homo Sapiens
  allele 24: 10-414-243 : polymorphic base A or G
gcggaattttgggatggggaagargagcattgaggaccgtgttcaag

SEQ ID NO: 544 - DNA, 47 bp, Homo Sapiens
  allele 24: 10-416-273 : polymorphic base A or T
tttctgtacttctgaaatttccawagtgctggtttggttccaaccct

SEQ ID NO: 545 - DNA, 47 bp, Homo Sapiens
  allele 24: 10-418-177 : polymorphic base A or G
gacttccgtgctacatgatgacaragaatttcctaatccaaatatct

SEQ ID NO: 546 - DNA, 47 bp, Homo Sapiens
  allele 24: 12-665-315 : polymorphic base T or C
ttagtttgtcaatttcccaaaacyttgggctggaatttctggcaggg

SEQ ID NO: 547 - DNA, 47 bp, Homo Sapiens
  allele 24: 12-666-324 : polymorphic base A or C
aactgttggctctgacacttaaamagctgtgtgaccttgaacaagat

SEQ ID NO: 548 - DNA, 47 bp, Homo Sapiens
  allele 24: 10-72-155 : polymorphic base A or G
tgttcactctgtattttggcctgraacccatrgtggtgctgcatgga

SEQ ID NO: 549 - DNA, 47 bp, Homo Sapiens
  allele 24: 10-76-177 : polymorphic base A or T
gacaccactccagttgtcaatggwtttgcctctgtgccgcccttcta

SEQ ID NO: 550 - DNA, 47 bp, Homo Sapiens
  allele 24: 10-76-217 : polymorphic base C or T
ccttctaccagctgtgcttcattyctgtctgaagaagagcagatggc

SEQ ID NO: 551 - DNA, 47 bp, Homo Sapiens
  allele 24: 10-76-333 : polymorphic base G or C
atgccttttctcacctgtcatctsacattttcccttccctgaagatc

SEQ ID NO: 552 - DNA, 47 bp, Homo Sapiens
  allele 24: 10-77-316 : polymorphic base A or T
ttagaccttccttcttttatgcawaatgtaggtcagaaattaaagaa

SEQ ID NO: 553 - DNA, 47 bp, Homo Sapiens
  allele 24: 10-155-78 : polymorphic base C or T
ttcatgagtcagggaccaagttaytgcttttctttgccctgtataaa

SEQ ID NO: 554 - DNA, 47 bp, Homo Sapiens
  allele 24: 10-155-104 : polymorphic base G or C
cttttctttgccctgtataaaggsttctccaaggcctttgacttacc

SEQ ID NO: 555 - DNA, 47 bp, Homo Sapiens
  allele 24: 10-156-52 : polymorphic base A or G
atgggtcaattttattgtaagcaraggtaattgagagattcaaaagg

SEQ ID NO: 556 - DNA, 47 bp, Homo Sapiens
  allele 24: 10-157-39 : polymorphic base C or T
gtgatttccctacctcccatcttytattgcatccacaactgtggttc

SEQ ID NO: 557 - DNA, 47 bp, Homo Sapiens
  allele 24: 10-157-131 : polymorphic base A or G
gaaaatgagaaaccaaaaacaatrgaaagcagccatgtctggaggtg

SEQ ID NO: 558 - DNA, 47 bp, Homo Sapiens
  allele 24: 10-157-166 : polymorphic base A or G
tgtctggaggtgactggggggtcragaagccctagtttctcaaaccc

SEQ ID NO: 559 - DNA, 47 bp, Homo Sapiens
  allele 24: 10-157-246 : polymorphic base A or G
cgtttcacttctgcagtgatggaraagggagatcccttatttcttct

SEQ ID NO: 560 - DNA, 47 bp, Homo Sapiens
  allele 24: 10-159-161 : polymorphic base A or T
tatattaaatatttgaaaggattwcattataaagaacaaagtctcct

SEQ ID NO: 561 - DNA, 47 bp, Homo Sapiens
  allele 24: 10-159-162 : polymorphic base A or C
atattaaatatttgaaaggatttmattataaagaacaaagtctccta

SEQ ID NO: 562 - DNA, 47 bp, Homo Sapiens
  allele 24: 10-83-169 : polymorphic base C or T
tctgttttgctattttcagggcaygaccataataacatccctgactt

SEQ ID NO: 563 - DNA, 47 bp, Homo Sapiens
  allele 24: 10-84-152 : polymorphic base C or T
ccaaaggatattgacatcaccccyattgccaatgcatttggtcgtgt

SEQ ID NO: 564 - DNA, 47 bp, Homo Sapiens
  allele 24: 10-84-243 : polymorphic base C or T
cagatagtttggctgctcctgtgytgtcacctgcaattctcccttat

SEQ ID NO: 565 - DNA, 47 bp, Homo Sapiens
  allele 24: 10-84-277 : polymorphic base A or G
aattctcccttatcagggccattrgcctctcccttctctctgtgagg

SEQ ID NO: 566 - DNA, 47 bp, Homo Sapiens
  allele 24: 10-84-295 : polymorphic base A or G
ccattggcctctcccttctctctrtgagggatattttctctgacttg

SEQ ID NO: 567 - DNA, 47 bp, Homo Sapiens
  allele 24: 10-85-43 : polymorphic base C or T
aaatatatctgctattctccataytctgtatcacttgtattgaccac

SEQ ID NO: 568 - DNA, 47 bp, Homo Sapiens
  allele 24: 10-85-117 : polymorphic base G or T
gagttgtcagtatgttatcactakaaaacaaagaaaaatgattaata

SEQ ID NO: 569 - DNA, 47 bp, Homo Sapiens
  allele 24: 10-85-320 : polymorphic base A or T
aagcacaaaaagggagaaaggtawgagggtaggaaagctgttttagc

SEQ ID NO: 570 - DNA, 47 bp, Homo Sapiens
  allele 24: 10-86-121 : polymorphic base A or C
cagctgtaacctgtagggaaatamtggaacaatcatccataagaggg

SEQ ID NO: 571 - DNA, 47 bp, Homo Sapiens
  allele 24: 12-244-275 : polymorphic base A or G
agaggggctagaggtttggcaagrgcggtggaagaggtgcagtggtg

SEQ ID NO: 572 - DNA, 47 bp, Homo Sapiens
  allele 24: 12-251-153 : polymorphic base A or C
gtgtaagctgagcctgtcctgggmagactggggacatgtggtcactc

SEQ ID NO: 573 - DNA, 47 bp, Homo Sapiens
  allele 24: 12-254-115 : polymorphic base A or T
ctcatttgtacaaataggatttgwctttccatctcactgagttgtga

SEQ ID NO: 574 - DNA, 47 bp, Homo Sapiens
  allele 24: 12-254-180 : polymorphic base A or G
gcatatgaagaggctagcaaaagrtatttaacaagcgttcaacattc

SEQ ID NO: 575 - DNA, 47 bp, Homo Sapiens
  allele 24: 12-265-300 : polymorphic base T or C
  misc_feature 19: n=a, g, c or t
gtttcccaccttccaattncctgycttctccaatgctcccttccgta

SEQ ID NO: 576 - DNA, 47 bp, Homo Sapiens
  allele 24: 12-271-118 : polymorphic base T or C
gtgcaaactcggagcaagtgtcayaattttctgtctccgatgtgtag

SEQ ID NO: 577 - DNA, 47 bp, Homo Sapiens
  allele 24: 12-272-112 : polymorphic base A or C
tttttcttgggggagagtactacmtcatattaacttacaataaagta

SEQ ID NO: 578 - DNA, 47 bp, Homo Sapiens
  allele 24: 10-216-182 : polymorphic base A or G
ctgatgtaggacaaaatctttctrctttgaactctagcctttcgggc

SEQ ID NO: 579 - DNA, 47 bp, Homo Sapiens
  allele 24: 10-217-91 : polymorphic base C or T
aaaacacatcataaaattcattayacaatgtcacttattgttccatg

SEQ ID NO: 580 - DNA, 47 bp, Homo Sapiens
  allele 24: 10-213-292 : polymorphic base G or C
tcatcatgacccaaagtactggasagagcctgagaagttcctccctg

SEQ ID NO: 581 - DNA, 47 bp, Homo Sapiens
  allele 24: 10-214-279 : polymorphic base C or T
ctaaggacttctggtttgctcttyaagaaagctgtgccccagaacac

SEQ ID NO: 582 - DNA, 47 bp, Homo Sapiens
  allele 24: 10-214-380 : polymorphic base A or G
tccaatgtgctgcataaataatcrgggattctgtacgtgcattgtgc

SEQ ID NO: 583 - DNA, 47 bp, Homo Sapiens
  allele 24: 2-1-216 : polymorphic base A or G
cattcatctctgactggttatatrtccagaagatgaacacgtggttt

SEQ ID NO: 584 - DNA, 47 bp, Homo Sapiens
  allele 24: 2-1-397 : polymorphic base C or T
gaaacattaaactcaaggtttcayaggtgacggaatatgcccagaga

SEQ ID NO: 585 - DNA, 47 bp, Homo Sapiens
  allele 24: 2-3-232 : polymorphic base C or T
atgttgagaaattccctcccaacyccaattgtgacttggttgatgga

SEQ ID NO: 586 - DNA, 47 bp, Homo Sapiens
  allele 24: 2-4-51 : polymorphic base A or C
actactgttgacctcagagcacgmgcctcttgcctaattctaggact

SEQ ID NO: 587 - DNA, 47 bp, Homo Sapiens
  allele 24: 2-4-126 : polymorphic base A or G
gaagaatgctggaggaatacggarctcctcccatttctcacagccac

SEQ ID NO: 588 - DNA, 47 bp, Homo Sapiens
  allele 24: 2-5-202 : polymorphic base A or G
cacttgctttgagagaactgaagrtattggaggagtgtggaggttca

SEQ ID NO: 589 - DNA, 47 bp, Homo Sapiens
  allele 24: 2-5-275 : polymorphic base A or G
gaacaggttgtgttgttatttcarggtgaatcacagttactgatggg

SEQ ID NO: 590 - DNA, 47 bp, Homo Sapiens
  allele 24: 2-5-346 : polymorphic base C or T
actctgatcagattttatttctayttattgatgtggccataatggaa

SEQ ID NO: 591 - DNA, 47 bp, Homo Sapiens
  allele 24: 2-8-171 : polymorphic base A or G
cacagaaacttctgccatctttgrggatggaacagtggaggagaaca

SEQ ID NO: 592 - DNA, 47 bp, Homo Sapiens
  allele 24: 2-9-188 : polymorphic base A or G
taggcttgtgtagcctgccctcaragagaactatgatgatggacatt

SEQ ID NO: 593 - DNA, 47 bp, Homo Sapiens
  allele 24: 2-9-223 : polymorphic base G or T
atgatggacattatcaaaaggaakgaaaaaagaattgacctgtaaga

SEQ ID NO: 594 - DNA, 47 bp, Homo Sapiens
  allele 24: 2-10-107 : polymorphic base C or T
aaaagcctgcttcatcttcctcaygcaggagaacatggccaagcgag

SEQ ID NO: 595 - DNA, 47 bp, Homo Sapiens
  allele 24: 2-10-378 : polymorphic base A or G
tagaaatgtctgctgaacaggggrccatgaggagccactgaaattgt

SEQ ID NO: 596 - DNA, 47 bp, Homo Sapiens
  allele 24: 2-11-284 : polymorphic base A or G
tgcaaacttctcggccttccaagragatttgtgtctatctccataac

SEQ ID NO: 597 - DNA, 47 bp, Homo Sapiens
  allele 24: 2-11-156 : polymorphic base A or C
agttttaagatcacatgagtaaamaaactaggtaggtaaactactct

SEQ ID NO: 598 - DNA, 47 bp, Homo Sapiens
  allele 24: 2-11-379 : polymorphic base A or G
tttaataaaaatttggccattccrttgttggaagttttaagataaat

SEQ ID NO: 599 - DNA, 47 bp, Homo Sapiens
  allele 24: 2-12-223 : polymorphic base A or T
ctatcgactctgtcatctttgcawcaggctatgattattcctacccc

SEQ ID NO: 600 - DNA, 47 bp, Homo Sapiens
  allele 24: 2-14-239 : polymorphic base C or T
agaaggatcttttaagatacatayagtttgaggtaggggtctcataa

SEQ ID NO: 601 - DNA, 47 bp, Homo Sapiens
  allele 24: 2-14-370 : polymorphic base G or C
gcacctcagtaatcaaatgttggstctgattataaagcattcatgca

SEQ ID NO: 602 - DNA, 47 bp, Homo Sapiens
  allele 24: 2-17-104 : polymorphic base A or G
tacacaaatttattaacttccacrggagttggggtaaaaatcacatg

SEQ ID NO: 603 - DNA, 47 bp, Homo Sapiens
  allele 24: 2-17-396 : polymorphic base A or C
aatgaaaactcagggaaggtaccmaaggtaattgatttcttctttgg

SEQ ID NO: 604 - DNA, 47 bp, Homo Sapiens
  allele 24: 2-22-43 : polymorphic base A or G
cagctgtgtttgaggatgggaccrtgtttgaggctatcgactctgtc

SEQ ID NO: 605 - DNA, 47 bp, Homo Sapiens
  allele 24: 2-22-138 : polymorphic base A or G
atcatgaaaagcagaaacaatgargttaccttgtttaaaggcatctt

SEQ ID NO: 606 - DNA, 47 bp, Homo Sapiens
  allele 24: 2-23-82 : polymorphic base A or G
ataaatggaaaaataaattttctrgttttcttaaagaccctggtttc

SEQ ID NO: 607 - DNA, 47 bp, Homo Sapiens
  allele 24: 2-23-166 : polymorphic base A or G
caatgggttgttgttactgaaaargatgggaaacaggaatctactat

SEQ ID NO: 608 - DNA, 47 bp, Homo Sapiens
  allele 24: 2-23-244 : polymorphic base G or T
cacgtataccccaatctgccaackgattcctttcctggtaagtttgg

SEQ ID NO: 609 - DNA, 47 bp, Homo Sapiens
  allele 24: 2-24-115 : polymorphic base C or T
ttcaaacaacttgccatgttccayttaggcctggaccagtttcgagg

SEQ ID NO: 610 - DNA, 47 bp, Homo Sapiens
  allele 24: 2-25-36 : polymorphic base G or C
ggaagtgcccaaagaagtgtgttstgtttgcttatttcttacagagt

SEQ ID NO: 611 - DNA, 47 bp, Homo Sapiens
  allele 24: 2-27-185 : polymorphic base A or G
tttggcccttgcagcccataccartttcgactgatgggaccagggaa

SEQ ID NO: 612 - DNA, 47 bp, Homo Sapiens
  allele 24: 2-27-378 : polymorphic base G or C
ttacacttacattttattaatgasaaagtctttgaggtctcaaaatt

SEQ ID NO: 613 - DNA, 47 bp, Homo Sapiens
  allele 24: 2-29-142 : polymorphic base A or G
caaaggccaatatttccatagccrccaatacaagcatccagatggat

SEQ ID NO: 614 - DNA, 47 bp, Homo Sapiens
  allele 24: 2-29-166 : polymorphic base C or T
ccaatacaagcatccagatggatytggggaaaacgcatcctggtgat

SEQ ID NO: 615 - DNA, 47 bp, Homo Sapiens
  allele 24: 2-29-205 : polymorphic base C or T
cctggtgattggaatgggaaactygggctcagatattgctgttgagc

SEQ ID NO: 616 - DNA, 47 bp, Homo Sapiens
  allele 24: 2-29-206 : polymorphic base A or G
ctggtgattggaatgggaaacttrggctcagatattgctgttgagct

SEQ ID NO: 617 - DNA, 47 bp, Homo Sapiens
  allele 24: 2-29-314 : polymorphic base C or T
tggggatgccatactggagaaccycagccatataatcgcggctccaa

SEQ ID NO: 618 - DNA, 47 bp, Homo Sapiens
  allele 24: 2-32-68 : polymorphic base A or G
agaaatgccatcttcacccagaarcaaagaatactgaagccactcaa

SEQ ID NO: 619 - DNA, 47 bp, Homo Sapiens
  allele 24: 2-35-357 : polymorphic base C or T
gaatctttaaaagcaggatgcatyctattgtttgctgaattatactg

SEQ ID NO: 620 - DNA, 47 bp, Homo Sapiens
  allele 24: 2-36-256 : polymorphic base G or C
cctttccaggtacagcattttctstaactaactttaagttttctcgt

SEQ ID NO: 621 - DNA, 47 bp, Homo Sapiens
  allele 24: 2-36-354 : polymorphic base A or C
tccattaaatagttaaagttgggmggtaggaggaggctttttttgtt

SEQ ID NO: 622 - DNA, 47 bp, Homo Sapiens
  allele 24: 2-42-236 : polymorphic base C or T
gaaactgcaagttagtcctgcctyctatccaccattttccaacaatc

SEQ ID NO: 623 - DNA, 47 bp, Homo Sapiens
  allele 24: 2-43-139 : polymorphic base A or G
gactctgataatagctggtgaacrcaatactcgaacccaggacttgt

SEQ ID NO: 624 - DNA, 47 bp, Homo Sapiens
  allele 24: 2-44-215 : polymorphic base C or T
tctcatccccttaaagaataaaaytgatgaacaagtgaggatgctgg

SEQ ID NO: 625 - DNA, 47 bp, Homo Sapiens
  allele 24: 2-45-38 : polymorphic base C or T
aaaaaacaaaaaatttttgaatgygtaattatcactaattattttat

SEQ ID NO: 626 - DNA, 47 bp, Homo Sapiens
  allele 24: 2-45-183 : polymorphic base C or T
aatgcctgaagattttccaaactycctgcataattctaaacttctgg

SEQ ID NO: 627 - DNA, 47 bp, Homo Sapiens
  allele 24: 2-45-335 : polymorphic base A or T
tttagatagaaaagttactctgawaatgaaagcaattatgaatgaag

SEQ ID NO: 628 - DNA, 47 bp, Homo Sapiens
  allele 24: 2-45-394 : polymorphic base C or T
agtatttgttgaaatataacagcytcatataaaacccaaaaagtagt

SEQ ID NO: 629 - DNA, 47 bp, Homo Sapiens
  allele 24: 2-48-39 : polymorphic base A or G
tgggctgtctggctccctcaactrcaaagtaaactccacaaaggcag

SEQ ID NO: 630 - DNA, 47 bp, Homo Sapiens
  allele 24: 2-48-72 : polymorphic base C or T
ctccacaaaggcagagagttttgyctcttttattcattgctgtacct

SEQ ID NO: 631 - DNA, 47 bp, Homo Sapiens
  allele 24: 2-48-156 : polymorphic base G or T
cagtaaatatttattgaataagtktatgtaaaacgtctcagactcct

SEQ ID NO: 632 - DNA, 47 bp, Homo Sapiens
  allele 24: 2-48-285 : polymorphic base A or G
ctagtctcctaagttagtctgctrataaatgttaaccctaataactg

SEQ ID NO: 633 - DNA, 47 bp, Homo Sapiens
  allele 24: 2-49-167 : polymorphic base A or G
gccagaacacaaatgtgaattccrtaagatcaggaacataatctgtc

SEQ ID NO: 634 - DNA, 47 bp, Homo Sapiens
  allele 24: 10-436-43 : polymorphic base G or C
tttgggtaaaagtttatgtctatstttgtatgtgggattcagtaggg

SEQ ID NO: 635 - DNA, 47 bp, Homo Sapiens
  allele 24: 10-436-376 : polymorphic base A or G
cccgaaacatttgtgaatctactrggagtcttatggttttattttcc

SEQ ID NO: 636 - DNA, 47 bp, Homo Sapiens
  allele 24: 10-431-51 : polymorphic base A or C
tagtggaacaatttagctatgttmaaacagacagtaagataaacact

SEQ ID NO: 637 - DNA, 48 bp, Homo Sapiens
  allele 25: 10-432-93 : polymorphic base A or G
  misc_feature 22: n=a, g, c or t
tatttcctcgtggtttgattgnagrttatgtatttctggtcatctccc

SEQ ID NO: 638 - DNA, 47 bp, Homo Sapiens
  allele 24: 12-631-208 : polymorphic base A or G
gctgtgactgtcgaagggaaaaartcacacttacctatatccgggat

SEQ ID NO: 639 - DNA, 47 bp, Homo Sapiens
  allele 24: 10-260-282 : polymorphic base G or T
ccaggtaggggacagtgaagcatkggggggccaggagctgccagagc

SEQ ID NO: 640 - DNA, 47 bp, Homo Sapiens
  allele 24: 10-263-26 : polymorphic base A or C
tattccaacctgaagtggatcttmcaggaatgtgatgggaggatgct

SEQ ID NO: 641 - DNA, 44 bp, Homo Sapiens
  allele 24: 10-258-408 : polymorphic base A or G
gtttcaatccttagccacccactratgctcttactggatcacag

SEQ ID NO: 642 - DNA, 47 bp, Homo Sapiens
  allele 24: 12-317-259 : polymorphic base G or A
actgtttcttgaaaatatttatcrcagaaagtcttgtcaggcctgcg

SEQ ID NO: 643 - DNA, 47 bp, Homo Sapiens
  allele 24: 12-323-385 : polymorphic base T or C
gaagcagttgttccccaatgcccyctgcacagcaaattcctgtcctc

SEQ ID NO: 644 - DNA, 47 bp, Homo Sapiens
  allele 24: 12-324-219 : polymorphic base C or T
ggtatggccatggcccggggggayagtcactacaaggggcatcagcg

SEQ ID NO: 645 - DNA, 47 bp, Homo Sapiens
  allele 24: 12-324-335 : polymorphic base G or C
ccacccaggtactaagaggcactscccggaattcagcacagatccga

SEQ ID NO: 646 - DNA, 47 bp, Homo Sapiens
  allele 24: 12-324-380 : polymorphic base A or G
gacactctctccagtggttttacrctcaagggtgctggattccttta

SEQ ID NO: 647 - DNA, 47 bp, Homo Sapiens
  allele 24: 12-325-30 : polymorphic base C or T
tgaagagcctttaggstgggagtycagagacatgggttcaagtccag

SEQ ID NO: 648 - DNA, 47 bp, Homo Sapiens
  allele 24: 12-327-31 : polymorphic base G or T
tgtcactagatacaaggtcttccktggtctgtgtacggttttcttcc

SEQ ID NO: 649 - DNA, 47 bp, Homo Sapiens
  allele 24: 12-327-415 : polymorphic base A or G
catgtgaggaaactgagggctagraaggttctgtattggatgcctgt

SEQ ID NO: 650 - DNA, 47 bp, Homo Sapiens
  allele 24: 12-331-270 : polymorphic base G or A
cccatcttaaacattgcatacctrgtaggggagataaacagagcccc

SEQ ID NO: 651 - DNA, 47 bp, Homo Sapiens
  allele 24: 12-331-275 : polymorphic base T or G
atattcccatcttaaacattgcakacctagtaggggagataaacaga

SEQ ID NO: 652 - DNA, 47 bp, Homo Sapiens
  allele 24: 12-334-320 : polymorphic base A or G
ttcttttgttcctggttgacccargagcctcttcctgccacctgggg

SEQ ID NO: 653 - DNA, 47 bp, Homo Sapiens
  allele 24: 12-334-391 : polymorphic base A or G
tcccctcaggtacaaaagccaacraggaaaggacatcaggaaacatt

SEQ ID NO: 654 - DNA, 47 bp, Homo Sapiens
  allele 24: 12-335-417 : polymorphic base G or C
tgcctctaatgctttccctgctgstatcccaggttaaaaaaaaatag

SEQ ID NO: 655 - DNA, 47 bp, Homo Sapiens
  allele 24: 12-337-189 : polymorphic base A or G
tccggaacgaaatcgcgagcccaratcaggagtggtggcgagagttc

SEQ ID NO: 656 - DNA, 47 bp, Homo Sapiens
  allele 24: 12-340-130 : polymorphic base A or G
ttaggacctttgttttccaaaaargtccaattttcacttaaagcatt

SEQ ID NO: 657 - DNA, 47 bp, Homo Sapiens
  allele 24: 12-340-210 : polymorphic base C or T
gcccatatgtttaaagacattccytatatacgtatktattttttatt

SEQ ID NO: 658 - DNA, 47 bp, Homo Sapiens
  allele 24: 12-340-222 : polymorphic base G or T
aaagacattccytatatacgtatktattttttattattgtttaaatc

SEQ ID NO: 659 - DNA, 47 bp, Homo Sapiens
  allele 24: 12-340-240 : polymorphic base C or T
cgtatktattttttattattgttyaaatcaagctaggagctacccca

SEQ ID NO: 660 - DNA, 47 bp, Homo Sapiens
  allele 24: 12-341-99 : polymorphic base A or G
cctaaactactacaccacagattrtcaattctagagaagcactgggc

SEQ ID NO: 661 - DNA, 47 bp, Homo Sapiens
  allele 24: 12-342-32 : polymorphic base T or C
gtggaaaaattataaatgccagtyaactggggcctgggtaaataaat

SEQ ID NO: 662 - DNA, 47 bp, Homo Sapiens
  allele 24: 12-344-349 : polymorphic base G or T
atggctcttaatgtctgatctatkactaattcttataaagaaactac

SEQ ID NO: 663 - DNA, 47 bp, Homo Sapiens
  allele 24: 12-345-453 : polymorphic base G or C
aatgaggccttatacagtatgtcstattggggtaaaaaaaaaatctt

SEQ ID NO: 664 - DNA, 47 bp, Homo Sapiens
  allele 24: 12-346-204 : polymorphic base G or A
cagaagacaggtcgctgagggaartccccagagtgcagtgaagagaa

SEQ ID NO: 665 - DNA, 47 bp, Homo Sapiens
  allele 24: 10-364-55 : polymorphic base G or T
attttctgttgagttgtcttagakaactaatttgaggtatgatttca

SEQ ID NO: 666 - DNA, 47 bp, Homo Sapiens
  allele 24: 10-364-108 : polymorphic base C or T
ttacttgtatgtaatcaaattctycttttacacgatgactcttaggt

SEQ ID NO: 667 - DNA, 47 bp, Homo Sapiens
  allele 24: 10-364-267 : polymorphic base A or T
tggggtgggagagagacatgttgwattgttgtttaatcctggattct

SEQ ID NO: 668 - DNA, 43 bp, Homo Sapiens
  allele 20: 10-367-20 : polymorphic base G or T
caaggaactggattcttcckggtatatttcactgtaagatagg

SEQ ID NO: 669 - DNA, 47 bp, Homo Sapiens
  allele 24: 10-351-389 : polymorphic base A or G
tctttaacttctctcatgaggctrcttgttcctaaagtttcaggtyc

SEQ ID NO: 670 - DNA, 47 bp, Homo Sapiens
  allele 24: 10-353-102 : polymorphic base A or T
ttccttaattaaataccagatcawcttaatattttcctggatgtgtg

SEQ ID NO: 671 - DNA, 47 bp, Homo Sapiens
  allele 24: 10-354-72 : polymorphic base A or G
tccagacccagatggggaattagragatggcttgggaatgacatgat

SEQ ID NO: 672 - DNA, 47 bp, Homo Sapiens
  allele 24: 10-354-320 : polymorphic base A or G
tggtgatgggtatagatctatctrtagatatatttatttatatatgc

SEQ ID NO: 673 - DNA, 47 bp, Homo Sapiens
  allele 24: 10-354-360 : polymorphic base A or G
tatatgctatttatttcccacctratttcatttgaaattgtttaccc

SEQ ID NO: 674 - DNA, 47 bp, Homo Sapiens
  allele 24: 10-355-87 : polymorphic base A or G
ctaattgcaaaggtgaggaaggtrctgcaacttgtatgtctgatcaa

SEQ ID NO: 675 - DNA, 47 bp, Homo Sapiens
  allele 24: 10-358-60 : polymorphic base A or G
tacgtggttttaatttttttttcrctcccccctcgcccacaggagaa

SEQ ID NO: 676 - DNA, 47 bp, Homo Sapiens
  allele 24: 12-468-63 : polymorphic base C or T
ccactgaaacactgtatgtatacyagtaaatgcttcctaatggtaga

SEQ ID NO: 677 - DNA, 47 bp, Homo Sapiens
  allele 24: 12-468-388 : polymorphic base C or T
tgaaactgtgtacatctattatgyatcattagagagatggaaaaaaa

SEQ ID NO: 678 - DNA, 47 bp, Homo Sapiens
  allele 24: 12-468-491 : polymorphic base A or G
taatggaagacttactgtataaarcaaaaaggatttwaaccacattc

SEQ ID NO: 679 - DNA, 47 bp, Homo Sapiens
  allele 24: 12-469-132 : polymorphic base C or T
taaacctctccaacttctcatctyccctcccctccaaaacacacaca

SEQ ID NO: 680 - DNA, 47 bp, Homo Sapiens
  allele 24: 12-469-245 : polymorphic base A or G
ctttcctgtttaattctaagtggraatgcatttagagtttcaacatt

SEQ ID NO: 681 - DNA, 47 bp, Homo Sapiens
  allele 24: 12-472-435 : polymorphic base A or G
tttttatctgaaatggggaaaaaratttggtctaggtggggagttaa

SEQ ID NO: 682 - DNA, 47 bp, Homo Sapiens
  allele 24: 12-473-311 : polymorphic base A or C
ttgaacatgctttctaagtagaamtaaactttaaaggataattattt

SEQ ID NO: 683 - DNA, 47 bp, Homo Sapiens
  allele 24: 12-473-483 : polymorphic base C or T
accagaaaaaaagggtatttaaaytgccttcagattttaaaaaacat

SEQ ID NO: 684 - DNA, 47 bp, Homo Sapiens
  allele 24: 12-475-85 : polymorphic base T or G
cttggaggtcttgaagccctgtcktcctgtccctggaggcatagtga

SEQ ID NO: 685 - DNA, 47 bp, Homo Sapiens
  allele 24: 12-475-446 : polymorphic base G or A
gcagratcaggacgagcctttctrtgaaaatcaggctgacctcattt

SEQ ID NO: 686 - DNA, 47 bp, Homo Sapiens
  allele 24: 12-477-100 : polymorphic base G or A
tcataaaatcacctctgataatargtatattcattatctccaaaaat

SEQ ID NO: 687 - DNA, 47 bp, Homo Sapiens
  allele 24: 12-477-331 : polymorphic base G or A
tatattcttaaagttagaaaactrtatatgaagcattactgatattg

SEQ ID NO: 688 - DNA, 47 bp, Homo Sapiens
  allele 24: 12-477-332 : polymorphic base T or C
atatattcttaaagttagaaaacygtatatgaagcattactgatatt

SEQ ID NO: 689 - DNA, 47 bp, Homo Sapiens
  allele 24: 12-477-44 : polymorphic base C or G
cccctttggtaatttcttcctctsgccatcccatgcagctgatttgc

SEQ ID NO: 690 - DNA, 47 bp, Homo Sapiens
  allele 24: 12-478-223 : polymorphic base G or A
aaggggagaaaggaaggcattatrgtcaaaagaacagtgtaacaaag

SEQ ID NO: 691 - DNA, 47 bp, Homo Sapiens
  allele 24: 12-478-320 : polymorphic base G or A
agagagagggggagagcacttcarttgattctggttttccttcagac

SEQ ID NO: 692 - DNA, 47 bp, Homo Sapiens
  allele 24: 12-479-289 : polymorphic base G or T
ttcataagcccacaaaaaaaatckatgtgtcattctacaccttcact

SEQ ID NO: 693 - DNA, 47 bp, Homo Sapiens
  allele 24: 12-482-237 : polymorphic base G or A
tgtatgtataatgtcatgtacacraaagcacatacagtttctacttt

SEQ ID NO: 694 - DNA, 47 bp, Homo Sapiens
  allele 24: 12-482-285 : polymorphic base T or A
aaatcatcaaatatatatgtttawaatatagttgtgtgtgtgatgtt

SEQ ID NO: 695 - DNA, 47 bp, Homo Sapiens
  allele 24: 12-482-482 : polymorphic base T or A
ttcatagtatcatgtgaaattctwtagtatgaatagacatttcaaag

SEQ ID NO: 696 - DNA, 47 bp, Homo Sapiens
  allele 24: 12-483-322 : polymorphic base T or A
catctatgtatctatgtgttatgwacacgtttcactactaaaaacat

SEQ ID NO: 697 - DNA, 47 bp, Homo Sapiens
  allele 24: 12-484-46 : polymorphic base G or A
ccaggcttcttggttgttgatgcrtgcaccaggcttgatttgtcaat

SEQ ID NO: 698 - DNA, 47 bp, Homo Sapiens
  allele 24: 12-490-312 : polymorphic base A or T
cctgggtgcagtctacagaatgawatcgagcagtagtggacctatgc

SEQ ID NO: 699 - DNA, 47 bp, Homo Sapiens
  allele 24: 12-491-295 : polymorphic base G or A
aggttccatgtattatcttttcartattcatgttatactgtacaagc

SEQ ID NO: 700 - DNA, 47 bp, Homo Sapiens
  allele 24: 12-493-417 : polymorphic base G or C
gggaaaaaatgtattgcagaagcstataactgggatcacaaaccatg

SEQ ID NO: 701 - DNA, 47 bp, Homo Sapiens
  allele 24: 12-494-373 : polymorphic base C or T
gagtacttaccaaatgctagagaytgacacaggctatgtcatttttt

SEQ ID NO: 702 - DNA, 47 bp, Homo Sapiens
  allele 24: 12-495-166 : polymorphic base C or T
ttacgtaaaatgcaaaattaggaycctcggaaggggaaaaaaagagt

SEQ ID NO: 703 - DNA, 47 bp, Homo Sapiens
  allele 24: 12-495-272 : polymorphic base A or T
gagacaacaacttcctatgggggwaaaaaaaacaaagcaactacttg

SEQ ID NO: 704 - DNA, 47 bp, Homo Sapiens
  allele 24: 12-495-424 : polymorphic base C or T
caagcttttgagaacaaatagttyatttctcctttcttaatttgctc

SEQ ID NO: 705 - DNA, 47 bp, Homo Sapiens
  allele 24: 12-500-220 : polymorphic base A or G
tataggaaagatatacaataatcraagaaataatagaatttttcctt

SEQ ID NO: 706 - DNA, 47 bp, Homo Sapiens
  allele 24: 12-501-155 : polymorphic base T or G
gccattgtagtgcttgacatgggkgaaagaggccagggggaggggga

SEQ ID NO: 707 - DNA, 47 bp, Homo Sapiens
  allele 24: 12-503-52 : polymorphic base T or G
ttctgttgatataacatcattctkaatgtgaacatacttaataatgt

SEQ ID NO: 708 - DNA, 47 bp, Homo Sapiens
  allele 24: 12-503-62 : polymorphic base T or A
tataacttttttctgttgatatawcatcattcttaatgtgaacatac

SEQ ID NO: 709 - DNA, 47 bp, Homo Sapiens
  allele 24: 12-504-54 : polymorphic base A or G
ttccttatggttttaagattaagragttgagtcccagagagtccctt

SEQ ID NO: 710 - DNA, 47 bp, Homo Sapiens
  allele 24: 12-504-96 : polymorphic base C or T
cccttaggtgttggaacgatagtyaacaagccatctgttgcccctcc

SEQ ID NO: 711 - DNA, 47 bp, Homo Sapiens
  allele 24: 12-504-428 : polymorphic base G or C
caaagtttatgatggcctttagtstctccaggagtttctcacagttt

SEQ ID NO: 712 - DNA, 47 bp, Homo Sapiens
  allele 24: 12-507-53 : polymorphic base C or T
gagaaactcatgtagtttctgttycaccttccattaaagccttcaat

SEQ ID NO: 713 - DNA, 47 bp, Homo Sapiens
  allele 24: 12-507-92 : polymorphic base A or G
ccttcaatgttaagctattatcargatatttttatatagactgggat

SEQ ID NO: 714 - DNA, 47 bp, Homo Sapiens
  allele 24: 12-507-159 : polymorphic base G or T
accaaaatgtaagtcactaagtakttatcctctcccttactcttact

SEQ ID NO: 715 - DNA, 47 bp, Homo Sapiens
  allele 24: 12-507-177 : polymorphic base G or C
aagtatttatcctctcccttactsttactatttctccatgatttctc

SEQ ID NO: 716 - DNA, 47 bp, Homo Sapiens
  allele 24: 12-508-29 : polymorphic base A or G
gctagtggtaaatgccatttaaaracttaaatcctaaaagcttgtat

SEQ ID NO: 717 - DNA, 47 bp, Homo Sapiens
  allele 24: 12-509-42 : polymorphic base A or G
tgttaacattttaaatgtcatccrtttggcatttaaaactgatattt

SEQ ID NO: 718 - DNA, 47 bp, Homo Sapiens
  allele 24: 12-509-126 : polymorphic base A or G
cctacccatgttttaaacttgtgrgctaagagtgaatttgaaaacta

SEQ ID NO: 719 - DNA, 47 bp, Homo Sapiens
  allele 24: 12-510-59 : polymorphic base G or A
tttgaaaggtttaagacaaaaacrgaagaagaaaaagaaggagaaag

SEQ ID NO: 720 - DNA, 47 bp, Homo Sapiens
  allele 24: 12-511-74 : polymorphic base T or C
aaattatgacgaccacactcttcygtggttataggaactttcacacc

SEQ ID NO: 721 - DNA, 47 bp, Homo Sapiens
  allele 24: 10-325-311 : polymorphic base A or G
cccgcaaaggagcagcgcctcacrgacaggctgtgactccctggcac

SEQ ID NO: 722 - DNA, 47 bp, Homo Sapiens
  allele 24: 10-327-120 : polymorphic base C or T
ggctatgccgaggcccaccgccgycatggccgcctgccctgggcgca

SEQ ID NO: 723 - DNA, 47 bp, Homo Sapiens
  allele 24: 10-331-179 : polymorphic base A or G
tgtagagacgctcaagtttgccarggggcagaggtggaggctggggg

SEQ ID NO: 724 - DNA, 47 bp, Homo Sapiens
  allele 24: 10-331-357 : polymorphic base G or T
tatgtggttctaggccagggcagkactgaaagggatcccggggtggc

SEQ ID NO: 725 - DNA, 47 bp, Homo Sapiens
  allele 24: 10-334-263 : polymorphic base A or G
ggtgagaacaaagcttcccacccrgggtccacaagggccccccacca

SEQ ID NO: 726 - DNA, 47 bp, Homo Sapiens
  allele 24: 10-321-226 : polymorphic base A or G
  misc_feature 6,8,25: n=a, g, c or t
ccccancntccatggtgccctccrncttgatcaacaaagcccagggg

SEQ ID NO: 727 - DNA, 47 bp, Homo Sapiens
  allele 24: 12-183-98 : polymorphic base G or A
tgctcaaagcccaggagggacccrcacagtggtcagcatggcaggga

SEQ ID NO: 728 - DNA, 47 bp, Homo Sapiens
  allele 24: 12-185-78 : polymorphic base C or T
ctcccaggggtttctttctaatcycaagggtggcctataccctggga

SEQ ID NO: 729 - DNA, 47 bp, Homo Sapiens
  allele 24: 12-186-154 : polymorphic base A or G
gagttggaatgtcagctattcagrtctagggctttccatggagtaaa

SEQ ID NO: 730 - DNA, 47 bp, Homo Sapiens
  allele 24: 12-186-397 : polymorphic base C or T
gtgggcaattagtaggtcaggcayggggaactcatagccaaacgtgc

SEQ ID NO: 731 - DNA, 47 bp, Homo Sapiens
  allele 24: 12-187-65 : polymorphic base C or T
tccacaggttaagtgtgtcgtgtygtcaggacctgagatctcttctg

SEQ ID NO: 732 - DNA, 47 bp, Homo Sapiens
  allele 24: 12-187-66 : polymorphic base A or G
ccacaggttaagtgtgtcgtgttrtcaggacctgagatctcttctgc

SEQ ID NO: 733 - DNA, 47 bp, Homo Sapiens
  allele 24: 12-189-348 : polymorphic base G or A
aggttcaactgaagaactctaatracttggctagaatacagtatggc

SEQ ID NO: 734 - DNA, 47 bp, Homo Sapiens
  allele 24: 12-192-63 : polymorphic base C or G
tgcgggcatgagaagaacaaggcstggcacttctgctcctgcagctg

SEQ ID NO: 735 - DNA, 47 bp, Homo Sapiens
  allele 24: 12-192-64 : polymorphic base T or C
atgcgggcatgagaagaacaaggygtggcacttctgctcctgcagct

SEQ ID NO: 736 - DNA, 47 bp, Homo Sapiens
  allele 24: 12-192-268 : polymorphic base C or G
agtcccaagactgcctgggcctastggcccccttagcatctgctgca

SEQ ID NO: 737 - DNA, 47 bp, Homo Sapiens
  allele 24: 12-192-334 : polymorphic base G or A
caggggcttctggtctgcctgccrtttctaaagcacccagtatggat

SEQ ID NO: 738 - DNA, 47 bp, Homo Sapiens
  allele 24: 12-192-352 : polymorphic base G or A
ctttgtcctcacttgcaacagggrcttctggtctgcctgccgtttct

SEQ ID NO: 739 - DNA, 47 bp, Homo Sapiens
  allele 24: 12-194-135 : polymorphic base G or T
ggtgtgtaggggttttcttgacaktttcagtaagaaagtgaatgttg

SEQ ID NO: 740 - DNA, 47 bp, Homo Sapiens
  allele 24: 12-194-325 : polymorphic base A or G
tgtttcaaaggtgaacttttaggrggtgtatctgcrgtgtttcctcc

SEQ ID NO: 741 - DNA, 47 bp, Homo Sapiens
  allele 24: 12-194-337 : polymorphic base A or G
gaacttttagggggtgtatctgcrgtgtttcctcctcagatgtgatt

SEQ ID NO: 742 - DNA, 47 bp, Homo Sapiens
  allele 24: 12-194-479 : polymorphic base C or T
catatttaaatcacatgactaacytgtgtgtggtattatgcaaactg

SEQ ID NO: 743 - DNA, 47 bp, Homo Sapiens
  allele 24: 10-442-133 : polymorphic base G or C
cagactcccacaggcatgcggggsgtgggctgagacctggctgcatc

SEQ ID NO: 744 - DNA, 47 bp, Homo Sapiens
  allele 24: 10-444-248 : polymorphic base A or G
  misc_feature 1..2,9,15,17: n=a, g, c or t
nndaccagnacaatnbnctcctcrcgtgggacctcagtgtccttgtc

SEQ ID NO: 745 - DNA, 47 bp, Homo Sapiens
  allele 24: 10-445-281 : polymorphic base C or T
gtcctgaggctggtggtgagggcygagggggcgacctccaccccgcc

SEQ ID NO: 746 - DNA, 47 bp, Homo Sapiens
  allele 24: 12-668-362 : polymorphic base T or A
caagggttggcctggactctccawccccctgctgtgcccaggactcc

SEQ ID NO: 747 - DNA, 47 bp, Homo Sapiens
  allele 24: 12-670-48 : polymorphic base G or C
ctgcgtgtggggggctgtacactsatcgggggctgtggacactgaga

SEQ ID NO: 748 - DNA, 47 bp, Homo Sapiens
  allele 24: 12-670-91 : polymorphic base C or T
gagagtggtcaagaagagacacgyaaagtctttgatgtcactgttgt

SEQ ID NO: 749 - DNA, 47 bp, Homo Sapiens
  allele 24: 12-670-157 : polymorphic base C or T
agctccacctctgacccttcattygtgagacattaaatccctgtgtt

SEQ ID NO: 750 - DNA, 47 bp, Homo Sapiens
  allele 24: 12-671-148 : polymorphic base C or T
ccgggggtgtccttctgttcgttyagatgacaccggctgcccctgcc

SEQ ID NO: 751 - DNA, 47 bp, Homo Sapiens
  allele 24: 12-679-245 : polymorphic base A or G
aaaatccccaaatttccaatcccrtttccgaacacaaagggccagcc

SEQ ID NO: 752 - DNA, 47 bp, Homo Sapiens
  allele 24: 12-679-371 : polymorphic base A or G
agcggcccagaaggggtggaggcrctcaaaggtagcttcctgctaag

SEQ ID NO: 753 - DNA, 47 bp, Homo Sapiens
  allele 24: 12-679-426 : polymorphic base C or T
gagaaatcgaccacctcaccccayaactgcgaccctatgcaactgat

SEQ ID NO: 754 - DNA, 47 bp, Homo Sapiens
  allele 24: 12-680-331 : polymorphic base C or T
aagaggcagctatgtcagcattcyctaacaaggtttggcaaagtaga

SEQ ID NO: 755 - DNA, 47 bp, Homo Sapiens
  allele 24: 10-151-154 : polymorphic base A or G
aggccaccaaagggtacctggacraccccacggtgccccgcgggtcc

SEQ ID NO: 756 - DNA, 47 bp, Homo Sapiens
  allele 24: 10-138-206 : polymorphic base C or T
aacgtgaagctccctgacgcctaygagcgcctcatcctggacgtctt

SEQ ID NO: 757 - DNA, 47 bp, Homo Sapiens
  allele 24: 10-138-352 : polymorphic base C or T
gccaccggcctcccaagccatacyatgtcccctcagcgacgagctcc

SEQ ID NO: 758 - DNA, 47 bp, Homo Sapiens
  allele 24: 12-586-414 : polymorphic base A or G
tcctggtggcataaagttttattracttcaacaaagagtgaagtaaa

SEQ ID NO: 759 - DNA, 45 bp, Homo Sapiens
  allele 24: 12-587-379 : polymorphic base C or A
aaaaggtggtagtgagcatagmactgcaacagttatattctgagt

SEQ ID NO: 760 - DNA, 47 bp, Homo Sapiens
  allele 24: 12-588-103 : polymorphic base G or A
attccccaaggatttaaaagtacraattaattattgccaagattaaa

SEQ ID NO: 761 - DNA, 47 bp, Homo Sapiens
  allele 24: 12-589-152 : polymorphic base T or G
gaagtggcattatttcatctgatktaatgttcatttgcagttatttt

SEQ ID NO: 762 - DNA, 47 bp, Homo Sapiens
  allele 24: 12-592-118 : polymorphic base A or T
acaccctcttacgtaaatcaaacwaggattccaccctgggaggtttg

SEQ ID NO: 763 - DNA, 47 bp, Homo Sapiens
  allele 24: 12-593-174 : polymorphic base T or C
gctttgcttttctgcttctgttayaacccatttttctagaaaagctt

SEQ ID NO: 764 - DNA, 47 bp, Homo Sapiens
  allele 24: 12-596-124 : polymorphic base A or G
gaaaggatagaatcacaggctgcrtctgcacctgaaaagtgacccgc

SEQ ID NO: 765 - DNA, 47 bp, Homo Sapiens
  allele 24: 12-602-196 : polymorphic base C or T
cttctcttttgatttctgcactcyctgttacgtggtgtgaaatttcc

SEQ ID NO: 766 - DNA, 47 bp, Homo Sapiens
  allele 24: 12-602-350 : polymorphic base A or C
tttttctttcagacaccaaacacmtttgctgtctgcacaaagcaccg

SEQ ID NO: 767 - DNA, 47 bp, Homo Sapiens
  allele 24: 12-603-191 : polymorphic base T or C
ggtaatagagacaaatttggctayttggatagctgagtctatgagaa

SEQ ID NO: 768 - DNA, 47 bp, Homo Sapiens
  allele 24: 12-783-73 : polymorphic base G or C
agaaggcttctgaggaggcgacastgcacagagacctaagtgaagtg

SEQ ID NO: 769 - DNA, 47 bp, Homo Sapiens
  allele 24: 12-783-421 : polymorphic base C or T
gccaatattctcaagttccaagayaccgatggcaaacacctgctgcc

SEQ ID NO: 770 - DNA, 47 bp, Homo Sapiens
  allele 24: 12-785-200 : polymorphic base C or T
atttggaagacaacaagttcataytaccagtctgtctgtccccccag

SEQ ID NO: 771 - DNA, 47 bp, Homo Sapiens
  allele 24: 12-785-393 : polymorphic base A or G
agagagaacgataacatctcactrtctgtgaaaataactaaatatag

SEQ ID NO: 772 - DNA, 47 bp, Homo Sapiens
  allele 24: 12-787-103 : polymorphic base G or A
tcacccaaattgcttctgtctcartgataccaagcactattctttaa

SEQ ID NO: 773 - DNA, 47 bp, Homo Sapiens
  allele 24: 12-790-396 : polymorphic base G or A
ataagttgggtttaagtcctctcrctgttatttccattgtgatcttg

SEQ ID NO: 774 - DNA, 47 bp, Homo Sapiens
  allele 24: 12-791-211 : polymorphic base A or G
agactgaatacaaggtattctatrtagctccacaaggaagaactagg

SEQ ID NO: 775 - DNA, 47 bp, Homo Sapiens
  allele 24: 12-792-233 : polymorphic base G or A
tgacactgaaaaaaaaacaaaacrctgaatttttcacacctatgtct

SEQ ID NO: 776 - DNA, 47 bp, Homo Sapiens
  allele 24: 12-793-383 : polymorphic base A or C
tttttcacaccgtttggaagacamgtgtttgatagatgatttcatgt

SEQ ID NO: 777 - DNA, 47 bp, Homo Sapiens
  allele 24: 12-803-125 : polymorphic base T or A
tttgcttattaaagccttagctcwtacacttgagattaccctttcct

SEQ ID NO: 778 - DNA, 47 bp, Homo Sapiens
  allele 24: 12-805-115 : polymorphic base G or A
ttaggttttgatcaagtcatggtraaatgttagttatcatgtatata

SEQ ID NO: 779 - DNA, 47 bp, Homo Sapiens
  allele 24: 12-808-52 : polymorphic base A or G
ctgtcctgggtgtttggggagaarcagaagaagggagggaggagcag

SEQ ID NO: 780 - DNA, 47 bp, Homo Sapiens
  allele 24: 12-808-75 : polymorphic base G or C
acagaagaagggagggaggagcasccctcaggttaaaagcaatgatt

SEQ ID NO: 781 - DNA, 47 bp, Homo Sapiens
  allele 24: 12-809-119 : polymorphic base G or C
  misc_feature 34: n=a, g, c or t
ggatataatgtctgtatttttgcstatgggcagnactggtgctggaa

SEQ ID NO: 782 - DNA, 47 bp, Homo Sapiens
  allele 24: 12-810-77 : polymorphic base G or A
aataactagagatgcagacagatrtgacgtgagaccaaagagtgaat

SEQ ID NO: 783 - DNA, 47 bp, Homo Sapiens
  allele 24: 10-265-178 : polymorphic base A or G
tttgtggtaagcggcgtgggcgcrttgtcttctctctggttcccggg

SEQ ID NO: 784 - DNA, 47 bp, Homo Sapiens
  allele 24: 10-266-203 : polymorphic base C or T
aataggactgtctccaaagttgaygatttcttggccaatgaggcaaa

SEQ ID NO: 785 - DNA, 47 bp, Homo Sapiens
  allele 24: 10-403-312 : polymorphic base C or T
actagccccagatatatgctgagyaagcattctgagataatttaaaa

SEQ ID NO: 786 - DNA, 47 bp, Homo Sapiens
  allele 24: 10-405-54 : polymorphic base C or T
agactgttccttcagaggaccccygttttctagttagtatagcagat

SEQ ID NO: 787 - DNA, 47 bp, Homo Sapiens
  allele 24: 10-408-356 : polymorphic base C or T
ttgaatatgtatcgtgccccctcyggtgtctttgatcaggatgacat

SEQ ID NO: 788 - DNA, 47 bp, Homo Sapiens
  allele 24: 10-409-148 : polymorphic base G or C
gcgggattcaaaggtggtcccacsgctgcccctactgcaaatggcag

SEQ ID NO: 789 - DNA, 47 bp, Homo Sapiens
  allele 24: 10-409-249 : polymorphic base G or C
aatggtcagtcctcatctctgtcstgcttcataggtgccaccttgtg

SEQ ID NO: 790 - DNA, 47 bp, Homo Sapiens
  allele 24: 10-410-274 : polymorphic base A or C
tttggaaaatatagaggttcacamacacaygccttcattgcgtgtgc

SEQ ID NO: 791 - DNA, 47 bp, Homo Sapiens
  allele 24: 10-410-280 : polymorphic base C or T
aaatatagaggttcacacacacaygccttcattgcgtgtgcatgcat

SEQ ID NO: 792 - DNA, 47 bp, Homo Sapiens
  allele 24: 10-410-337 : polymorphic base A or G
gaaaagaaaaataaccagtaatcrcatcgcccagaaataaccccagt

SEQ ID NO: 793 - DNA, 47 bp, Homo Sapiens
  allele 24: 12-121-326 : polymorphic base A or G
ctgaccggggctgaagacatcctrttgtttaggactgcggttctcca

SEQ ID NO: 794 - DNA, 47 bp, Homo Sapiens
  allele 24: 12-122-341 : polymorphic base C or T
aattgtaatccccataatccccaygtgttgaggacaggacatggtgg

SEQ ID NO: 795 - DNA, 47 bp, Homo Sapiens
  allele 24: 12-122-381 : polymorphic base A or C
atggtgggaggtccccacctcctmatctcatcatagtgagtgagttc

SEQ ID NO: 796 - DNA, 47 bp, Homo Sapiens
  allele 24: 12-124-169 : polymorphic base G or T
aaactccctcaagaagacccgggkgtctagctggagcctgcgcttga

SEQ ID NO: 797 - DNA, 47 bp, Homo Sapiens
  allele 24: 12-124-194 : polymorphic base C or T
tctagctggagcctgcgcttgagyaaagagctgaacaaccagattgc

SEQ ID NO: 798 - DNA, 47 bp, Homo Sapiens
  allele 24: 12-124-300 : polymorphic base G or T
caaggagtagactccaggggtgakggagtggagaggataacaccgtg

SEQ ID NO: 799 - DNA, 47 bp, Homo Sapiens
  allele 24: 12-124-58 : polymorphic base A or C
agggcaagtcagtactcaaggtcmcgtagcattcccagagcccaggc

SEQ ID NO: 800 - DNA, 47 bp, Homo Sapiens
  allele 24: 12-126-222 : polymorphic base T or C
tgagcctccatctctatctcatgyggatttatgtccacagcactgct

SEQ ID NO: 801 - DNA, 47 bp, Homo Sapiens
  allele 24: 12-126-297 : polymorphic base T or C
ggtgttctgggctctacccatagytcctggaaaagtggatcttgtcg

SEQ ID NO: 802 - DNA, 47 bp, Homo Sapiens
  allele 24: 12-128-225 : polymorphic base T or G
tgaaaggagatgaaaggagctggkagtgtgtctgatggtggcctact

SEQ ID NO: 803 - DNA, 47 bp, Homo Sapiens
  allele 24: 12-129-176 : polymorphic base G or T
agcgtataagcccagttaagctgkggacggtgatgaatggacatgtg

SEQ ID NO: 804 - DNA, 47 bp, Homo Sapiens
  allele 24: 12-130-203 : polymorphic base C or T
ttccgaggggactttgtgatggaytaccccaggccgatcatgcccaa

SEQ ID NO: 805 - DNA, 47 bp, Homo Sapiens
  allele 24: 12-130-260 : polymorphic base C or T
attgggggcatcaactgtgccaaygggaagccactatctcaggtctg

SEQ ID NO: 806 - DNA, 47 bp, Homo Sapiens
  allele 24: 12-131-112 : polymorphic base T or C
aatgcaagacaattatagattaaygggtaataagtaactggaggagg

SEQ ID NO: 807 - DNA, 47 bp, Homo Sapiens
  allele 24: 12-132-157 : polymorphic base C or T
ggtcatgttagaattgtgtaaacytcctttggatagctcactcctca

SEQ ID NO: 808 - DNA, 47 bp, Homo Sapiens
  allele 24: 12-132-437 : polymorphic base A or C
tgctcctgtccccttccctccaamtctgccccaagggcatcgctggt

SEQ ID NO: 809 - DNA, 47 bp, Homo Sapiens
  allele 24: 12-133-153 : polymorphic base T or C
gagactgcagtcctttctggagtycagcttcctcttccaagctcatg

SEQ ID NO: 810 - DNA, 47 bp, Homo Sapiens
  allele 24: 12-133-318 : polymorphic base T or A
agaagagagggcgagagggctctwttaaactaaggatattatctatt

SEQ ID NO: 811 - DNA, 47 bp, Homo Sapiens
  allele 24: 12-136-238 : polymorphic base A or G
aaaatgcgaaggacacatttggcrgtgaggatgctgtgcacaatcaa

SEQ ID NO: 812 - DNA, 47 bp, Homo Sapiens
  allele 24: 12-138-141 : polymorphic base G or A
ccaggtgatgccaaggctgatctrgagagcctactttgagaactgtt

SEQ ID NO: 813 - DNA, 47 bp, Homo Sapiens
  allele 24: 12-138-42 : polymorphic base T or G
gcagaggagcttatttataaaaakttttattatttttgttggatttg

SEQ ID NO: 814 - DNA, 47 bp, Homo Sapiens
  allele 24: 12-138-67 : polymorphic base G or A
agtgggtagcaaaggggtgctatragcagaggagcttatttataaaa

SEQ ID NO: 815 - DNA, 47 bp, Homo Sapiens
  allele 24: 12-139-380 : polymorphic base A or G
ccctgacaaagactggatttggcrgtggagccagttcagggctgaga

SEQ ID NO: 816 - DNA, 47 bp, Homo Sapiens
  allele 24: 12-140-134 : polymorphic base G or T
cacaactcactcgcgtgcttcctktatcctgatggggtatgaggctg

SEQ ID NO: 817 - DNA, 47 bp, Homo Sapiens
  allele 24: 12-140-329 : polymorphic base C or T
atggtgcactgcttcgtagccctyggtgaggctctgcggcagggtgc

SEQ ID NO: 818 - DNA, 47 bp, Homo Sapiens
  allele 24: 12-140-385 : polymorphic base G or C
  misc_feature 45: n=a, g, c or t
gccccgaggcctgcaggaggcctstaggagtcccggcccctctgngc

SEQ ID NO: 819 - DNA, 47 bp, Homo Sapiens
  allele 24: 12-141-159 : polymorphic base T or C
ctcagtgagtgagttgaagggctyagtcaactatttgttgataccac

SEQ ID NO: 820 - DNA, 47 bp, Homo Sapiens
  allele 24: 12-141-392 : polymorphic base C or A
tctgtagcaggggtctcacttggmggctccccagggcaatgggccag

SEQ ID NO: 821 - DNA, 47 bp, Homo Sapiens
  allele 24: 12-142-315 : polymorphic base A or G
gcatcagcagcacagcggtctgcrtggaaatgaggcaccgggtgtgg

SEQ ID NO: 822 - DNA, 47 bp, Homo Sapiens
  allele 24: 12-142-321 : polymorphic base A or G
gcagcacagcggtctgcgtggaartgaggcaccgggtgtgggcgggg

SEQ ID NO: 823 - DNA, 47 bp, Homo Sapiens
  allele 24: 12-143-453 : polymorphic base A or G
tggagtggagcttggttctggccrtgggctggggaagggaggtccgg

SEQ ID NO: 824 - DNA, 47 bp, Homo Sapiens
  allele 24: 12-144-169 : polymorphic base G or A
gagtttgcttaatcttttacttcrtgtggcctctgattggctgcctg

SEQ ID NO: 825 - DNA, 47 bp, Homo Sapiens
  allele 24: 12-144-33 : polymorphic base G or A
tttgtaattaagcacttcagttcrtgagaccacagaacagcaatgag

SEQ ID NO: 826 - DNA, 47 bp, Homo Sapiens
  allele 24: 12-146-174 : polymorphic base T or C
gtgtgaacaaagcaatttgggaayatcaaagcaagtttggagaacaa

SEQ ID NO: 827 - DNA, 47 bp, Homo Sapiens
  allele 24: 12-146-47 : polymorphic base G or A
acaggggggctggggtctatcccrgagttttgagagcaaggcagagg

SEQ ID NO: 828 - DNA, 47 bp, Homo Sapiens
  allele 24: 12-148-283 : polymorphic base G or A
ccttacaagaaatatcctggtgcraaaaacgaccaaaaccacatagc

SEQ ID NO: 829 - DNA, 47 bp, Homo Sapiens
  allele 24: 12-148-311 : polymorphic base T or C
agccacttcagagagagtcctctytgatccttacaagaaatatcctg

SEQ ID NO: 830 - DNA, 47 bp, Homo Sapiens
  allele 24: 12-149-320 : polymorphic base T or C
tgaggaacacggctgttgggtgcytgagtacttgcctcgtcagggat

SEQ ID NO: 831 - DNA, 47 bp, Homo Sapiens
  allele 24: 12-151-174 : polymorphic base G or T
cagggtctggggcgcagggatggkcgtctggtgcagggagagaagtg

SEQ ID NO: 832 - DNA, 47 bp, Homo Sapiens
  allele 24: 12-151-196 : polymorphic base C or T
ggcgtctggtgcagggagagaagygggctgggcaggaggaccctggt

SEQ ID NO: 833 - DNA, 47 bp, Homo Sapiens
  allele 24: 12-151-270 : polymorphic base A or G
gaaggctcagcaaaatgaggcagrggccaagtccaacactcagtaac

SEQ ID NO: 834 - DNA, 47 bp, Homo Sapiens
  allele 24: 12-152-453 : polymorphic base C or T
tggcctttccctgtgtgtccctcygtgtcctcttcttacaaggacac

SEQ ID NO: 835 - DNA, 47 bp, Homo Sapiens
  allele 24: 12-153-116 : polymorphic base C or T
tcgtgacagtgtggctgaggcacyacaaccccgaggtgagatgcacc

SEQ ID NO: 836 - DNA, 47 bp, Homo Sapiens
  allele 24: 12-154-480 : polymorphic base C or T
ttttatcgtttgtactttttgtaycctaaggaagctttgttacccca

SEQ ID NO: 837 - DNA, 47 bp, Homo Sapiens
  allele 24: 12-155-403 : polymorphic base A or C
tcatctttcccttttgacttcaamtcagtcatcagaatttccccaaa

SEQ ID NO: 838 - DNA, 47 bp, Homo Sapiens
  allele 24: 12-156-91 : polymorphic base A or G
gaccccgttaacctctgcgcggcrgtgctggctaagtacctgtcgat

SEQ ID NO: 839 - DNA, 47 bp, Homo Sapiens
  allele 24: 12-157-437 : polymorphic base A or C
acagagatacataagacctagtcmcagccttttaaggacttagagat

SEQ ID NO: 840 - DNA, 47 bp, Homo Sapiens
  allele 24: 12-158-213 : polymorphic base T or C
ttgagaagctgagatgttgcaccyacagctgagaatccctttctagc

SEQ ID NO: 841 - DNA, 47 bp, Homo Sapiens
  allele 24: 12-158-450 : polymorphic base T or G
caagatacatgggcctccgcaggkctaggagtgccagacacgtaacc

SEQ ID NO: 842 - DNA, 47 bp, Homo Sapiens
  allele 24: 12-161-157 : polymorphic base A or G
tttccttgcccagtgtacttggtragaaggtacaggtgtttccatgg

SEQ ID NO: 843 - DNA, 44 bp, Homo Sapiens
  allele 21: 12-162-21 : polymorphic base A or G
tctggtggacagctccattcrctgcctgtcccatgggttctgtc

SEQ ID NO: 844 - DNA, 47 bp, Homo Sapiens
  allele 24: 10-470-25 : polymorphic base A or T
tttactccaataattcctgataawacttgattttctctctttttata

SEQ ID NO: 845 - DNA, 47 bp, Homo Sapiens
  allele 24: 10-471-84 : polymorphic base A or T
gatcaaccagtgaagccccttgawcgagcagtcttctggattgaatt

SEQ ID NO: 846 - DNA, 47 bp, Homo Sapiens
  allele 24: 10-471-85 : polymorphic base A or C
atcaaccagtgaagccccttgatmgagcagtcttctggattgaattt

SEQ ID NO: 847 - DNA, 47 bp, Homo Sapiens
  allele 24: 10-472-202 : polymorphic base C or T
aacaaaaatgatataaagccataygaggttatattgaaatgtattga

SEQ ID NO: 848 - DNA, 47 bp, Homo Sapiens
  allele 24: 10-473-333 : polymorphic base C or T
ttgagatgattagtgctgcttggyttttattgtgcatcgtgcttcaa

SEQ ID NO: 849 - DNA, 47 bp, Homo Sapiens
  allele 24: 10-494-284 : polymorphic base C or T
acagattattaaagtgttaatagytatcatgaaacaagcttactgaa

SEQ ID NO: 850 - DNA, 47 bp, Homo Sapiens
  allele 24: 12-637-219 : polymorphic base G or A
ttgttttaactgttgttgaggaarctaataaataattaaattgtata

SEQ ID NO: 851 - DNA, 47 bp, Homo Sapiens
  allele 24: 12-639-95 : polymorphic base G or A
atgaagttatacataaaaccctarcagcatttatttatttcttataa

SEQ ID NO: 852 - DNA, 47 bp, Homo Sapiens
  allele 24: 12-639-241 : polymorphic base T or G
ttttgtattcatgataccaacagkttcctcatttctaggccaaaaaa

SEQ ID NO: 853 - DNA, 47 bp, Homo Sapiens
  allele 24: 12-640-151 : polymorphic base G or A
taattatagtattataagtgaagrgtctgggtatattttttcacatt

SEQ ID NO: 854 - DNA, 47 bp, Homo Sapiens
  allele 24: 12-640-296 : polymorphic base T or G
tttagggaagtagaccactaatgkcttcaaactaaaagaattctaca

SEQ ID NO: 855 - DNA, 47 bp, Homo Sapiens
  allele 24: 12-640-325 : polymorphic base T or C
tgtgaatagcttttcctcagtgcycatatttagggaagtagaccact

SEQ ID NO: 856 - DNA, 47 bp, Homo Sapiens
  allele 24: 12-640-413 : polymorphic base C or G
gaaaaactactggaaaactctgasaaactttaagtgaagcataaagc

SEQ ID NO: 857 - DNA, 47 bp, Homo Sapiens
  allele 24: 12-641-120 : polymorphic base G or A
tggtagaaaaacaaggctctggtrtcaagccagtgagatgaaacact

SEQ ID NO: 858 - DNA, 47 bp, Homo Sapiens
  allele 24: 12-641-122 : polymorphic base T or G
cctggtagaaaaacaaggctctgktatcaagccagtgagatgaaaca

SEQ ID NO: 859 - DNA, 47 bp, Homo Sapiens
  allele 24: 12-641-223 : polymorphic base G or A
tacattaattttgtattatttttrtaatattatcacaaaaggagaaa

SEQ ID NO: 860 - DNA, 47 bp, Homo Sapiens
  allele 24: 12-641-267 : polymorphic base T or C
aaaattatcttttaaaaaggtttycatacttttataaaatttcttac

SEQ ID NO: 861 - DNA, 47 bp, Homo Sapiens
  allele 24: 12-642-387 : polymorphic base A or G
aaaccgatatgactaaaaatgacraaaacataaaggagctaggaggt

SEQ ID NO: 862 - DNA, 47 bp, Homo Sapiens
  allele 24: 12-642-417 : polymorphic base A or G
taaaggagctaggaggttatatgraaatggaatattacataaaaatt

SEQ ID NO: 863 - DNA, 47 bp, Homo Sapiens
  allele 24: 12-646-429 : polymorphic base C or T
atttcaagcatgtgggaattaaayttgtagcataaaccaagggctga

SEQ ID NO: 864 - DNA, 47 bp, Homo Sapiens
  allele 24: 12-646-433 : polymorphic base G or T
caagcatgtgggaattaaatttgkagcataaaccaagggctgacaaa

SEQ ID NO: 865 - DNA, 47 bp, Homo Sapiens
  allele 24: 12-647-145 : polymorphic base A or G
ggtattatttcctaggcttctccrcaggagttgaggaatggctagct

SEQ ID NO: 866 - DNA, 47 bp, Homo Sapiens
  allele 24: 12-648-123 : polymorphic base A or G
tgaagtgtgcatgtgcatcctccrcataggacatggtgaggtgatga

SEQ ID NO: 867 - DNA, 47 bp, Homo Sapiens
  allele 24: 12-648-300 : polymorphic base C or T
gattatcagtaggattttgaggaygagttcacagaaattcaaaacca

SEQ ID NO: 868 - DNA, 47 bp, Homo Sapiens
  allele 24: 12-648-402 : polymorphic base G or C
gtgatgaaggagtgatttagaagsaaggtttgggaaattctgacaaa

SEQ ID NO: 869 - DNA, 47 bp, Homo Sapiens
  allele 24: 12-652-115 : polymorphic base C or T
ttcaacaaagtgttttatttttcyttatttttacatctcctatttgt

SEQ ID NO: 870 - DNA, 47 bp, Homo Sapiens
  allele 24: 12-652-203 : polymorphic base A or C
atttcctagttgctctgttattamatatattcagcagtgttgtgatt

SEQ ID NO: 871 - DNA, 47 bp, Homo Sapiens
  allele 24: 12-652-274 : polymorphic base G or T
ttttgtattgaagtctgtcccttkagaattgcaataaaccaagctct

SEQ ID NO: 872 - DNA, 47 bp, Homo Sapiens
  allele 24: 12-652-371 : polymorphic base C or T
tgaaatgtaaaataaaaccaaaaygcatgaaatagaagaaatgtatt

SEQ ID NO: 873 - DNA, 47 bp, Homo Sapiens
  allele 24: 12-653-423 : polymorphic base T or A
aatggactagaaagtggatagaawtacctatgcctacttttacagta

SEQ ID NO: 874 - DNA, 47 bp, Homo Sapiens
  allele 24: 12-654-115 : polymorphic base T or C
atgggacacagtttctatcccaayacaccttacattctattttgaaa

SEQ ID NO: 875 - DNA, 47 bp, Homo Sapiens
  allele 24: 12-654-207 : polymorphic base G or A
ttaaagctttgattatgcaacatrtaagaaggtactggccattcatt

SEQ ID NO: 876 - DNA, 47 bp, Homo Sapiens
  allele 24: 12-657-396 : polymorphic base A or G
acaatttggaaagtattatggtartttatgtgagcacaactgattat

SEQ ID NO: 877 - DNA, 47 bp, Homo Sapiens
  allele 24: 12-658-120 : polymorphic base A or T
ttcaattaattttattactgtaawtctagttttcctctctttagtta

SEQ ID NO: 878 - DNA, 47 bp, Homo Sapiens
  allele 24: 12-659-382 : polymorphic base A or G
aatttgtggtgatgctaaatttcrttctgctggctcttaactcttca

SEQ ID NO: 879 - DNA, 47 bp, Homo Sapiens
  allele 24: 12-660-134 : polymorphic base A or G
ctatcacactcagtgacttcactrtttctctaagagaatatgttcta

SEQ ID NO: 880 - DNA, 47 bp, Homo Sapiens
  allele 24: 12-662-80 : polymorphic base G or C
cctgggggaactcgtcttgacatsataggtgactgacagagatgcac

SEQ ID NO: 881 - DNA, 47 bp, Homo Sapiens
  allele 24: 12-906-149 : polymorphic base A or G
aagatatcaaaaagaaatgcaatrttgcaatgtatcagggaaaattt

SEQ ID NO: 882 - DNA, 47 bp, Homo Sapiens
  allele 24: 12-906-154 : polymorphic base A or C
atcaaaaagaaatgcaatgttgcmatgtatcagggaaaatttgttcc

SEQ ID NO: 883 - DNA, 47 bp, Homo Sapiens
  allele 24: 12-906-251 : polymorphic base A or T
gattgatgataaagaaattttttwaaattctttagatttaataattc

SEQ ID NO: 884 - DNA, 47 bp, Homo Sapiens
  allele 24: 12-906-451 : polymorphic base A or C
actattttcattaattctatatamtaagtgcaaagtgttcagtattt

SEQ ID NO: 885 - DNA, 47 bp, Homo Sapiens
  allele 24: 12-907-199 : polymorphic base G or T
tattaattgcagccccccattgtkccagctaatctctgcctcaaaga

SEQ ID NO: 886 - DNA, 47 bp, Homo Sapiens
  allele 24: 12-907-482 : polymorphic base A or T
gtgggccattgtttagaaattacwttaatccaataagcggctttttc

SEQ ID NO: 887 - DNA, 47 bp, Homo Sapiens
  allele 24: 12-909-36 : polymorphic base A or G
aaatgttagtttgagctcgagaargaatctggatactggtaacttta

SEQ ID NO: 888 - DNA, 47 bp, Homo Sapiens
  allele 24: 12-909-176 : polymorphic base C or T
ttcgctgtgatcatgggcctaatyagagtcactgcactggcaaccac

SEQ ID NO: 889 - DNA, 47 bp, Homo Sapiens
  allele 24: 12-909-484 : polymorphic base G or T
aaatggtcaaaggacaccttctgkgtagggaagataatttattcttg

SEQ ID NO: 890 - DNA, 47 bp, Homo Sapiens
  allele 24: 12-910-76 : polymorphic base A or G
actgtaccaccccgcttccacaarccaaaatgacaccactgtgaggg

SEQ ID NO: 891 - DNA, 47 bp, Homo Sapiens
  allele 24: 12-910-295 : polymorphic base C or T
tggagtagtaatcacagtgatcaycacacagatcttggcatctgctt

SEQ ID NO: 892 - DNA, 45 bp, Homo Sapiens
  allele 22: 12-911-22 : polymorphic base G or C
tattcacaatatgctggtcctstgtagtgcataaatatgaactga

SEQ ID NO: 893 - DNA, 47 bp, Homo Sapiens
  allele 24: 12-912-65 : polymorphic base C or T
actatattctaaaatcattgtagycacgaaatcatatgaatacctgc

SEQ ID NO: 894 - DNA, 47 bp, Homo Sapiens
  allele 24: 12-914-106 : polymorphic base C or T
tgaatttcttgtcaaaaattttayggagcatctgaaccttaattctg

SEQ ID NO: 895 - DNA, 47 bp, Homo Sapiens
  allele 24: 12-914-252 : polymorphic base A or T
catagaaaagctccgtatgagtawctgggaattataaaaatacctgc

SEQ ID NO: 896 - DNA, 47 bp, Homo Sapiens
  allele 24: 10-448-266 : polymorphic base A or C
accctgtggtgagctgctggctgmgctatttaacataccctttgtgt

SEQ ID NO: 897 - DNA, 47 bp, Homo Sapiens
  allele 24: 10-453-330 : polymorphic base C or T
  misc_feature 41: n=a, g, c or t
tagatggtattaatagatagcttytcttgtcagtagtgagncatgag

SEQ ID NO: 898 - DNA, 47 bp, Homo Sapiens
  allele 24: 10-455-367 : polymorphic base C or T
cctgatagataggaatacttcagytgattccagcaataaatattgtg

SEQ ID NO: 899 - DNA, 47 bp, Homo Sapiens
  allele 24: 12-5-158 : polymorphic base C or T
aagaatatccatccagtccacatyaagctaaaagacaccaccacttt

SEQ ID NO: 900 - DNA, 47 bp, Homo Sapiens
  allele 24: 12-9-367 : polymorphic base G or A
tcttagtttttctctcccatcacrgaaattccatcctatgagtggac

SEQ ID NO: 901 - DNA, 47 bp, Homo Sapiens
  allele 24: 12-10-303 : polymorphic base T or C
agtcttctccattgccttttatcyaaaagataaactcaattggcttg

SEQ ID NO: 902 - DNA, 47 bp, Homo Sapiens
  allele 24: 12-14-264 : polymorphic base C or T
gcatgctttgcatttgcctgagcygtgtctttgtaggtatatgtcat

SEQ ID NO: 903 - DNA, 47 bp, Homo Sapiens
  allele 24: 12-17-86 : polymorphic base T or A
tgtgggactgaataatcatgactwcttagtctcttctttgcatcatt

SEQ ID NO: 904 - DNA, 47 bp, Homo Sapiens
  allele 24: 12-19-163 : polymorphic base A or G
aattaggcatccagtaaatttatrgatggtagttttgacagatgtat

SEQ ID NO: 905 - DNA, 47 bp, Homo Sapiens
  allele 24: 10-457-284 : polymorphic base G or T
atcctacatctttaactaaaaatkatttggaagattctcttctgaaa

SEQ ID NO: 906 - DNA, 47 bp, Homo Sapiens
  allele 24: 10-460-221 : polymorphic base C or T
ttcactgtaaaccagccaaacccytgcctaaggtaaatgtattcttg

SEQ ID NO: 907 - DNA, 47 bp, Homo Sapiens
  allele 24: 10-460-232 : polymorphic base A or G
ccagccaaacccctgcctaaggtraatgtattcttgtttcatttgtt

SEQ ID NO: 908 - DNA, 47 bp, Homo Sapiens
  allele 24: 10-460-235 : polymorphic base C or T
gccaaacccctgcctaaggtaaaygtattcttgtttcatttgtttgc

SEQ ID NO: 909 - DNA, 47 bp, Homo Sapiens
  allele 24: 10-460-236 : polymorphic base A or G
ccaaacccctgcctaaggtaaatrtattcttgtttcatttgtttgct

SEQ ID NO: 910 - DNA, 47 bp, Homo Sapiens
  allele 24: 10-460-285 : polymorphic base A or T
acattttcagaaggaatggctggwtatgtttctttcagagtgtttaa

SEQ ID NO: 911 - DNA, 47 bp, Homo Sapiens
  allele 24: 12-605-58 : polymorphic base G or T
tctttcattctcttttgtcttatkctgggcagggtctcctggcctca

SEQ ID NO: 912 - DNA, 47 bp, Homo Sapiens
  allele 24: 12-607-207 : polymorphic base G or A
gacctatggcatgaatgtattctraaaataaattaaaattttgatgc

SEQ ID NO: 913 - DNA, 47 bp, Homo Sapiens
  allele 24: 12-609-119 : polymorphic base T or G
acctctcccactgtggttcaagtkccccctgtgagacacagcaaagt

SEQ ID NO: 914 - DNA, 47 bp, Homo Sapiens
  allele 24: 12-609-180 : polymorphic base T or G
tatagtgtgagggagctactctakggggtgagcagatctccactgga

SEQ ID NO: 915 - DNA, 47 bp, Homo Sapiens
  allele 24: 12-609-233 : polymorphic base G or A
tcagaataattctcattcatttcraagcaaacacatattcaccagga

SEQ ID NO: 916 - DNA, 47 bp, Homo Sapiens
  allele 24: 12-611-294 : polymorphic base G or A
gattttgaacagtgtctctgttcragtataaaaatatgttccaccac

SEQ ID NO: 917 - DNA, 47 bp, Homo Sapiens
  allele 24: 12-612-41 : polymorphic base C or T
ccaccgaaaattccatttttcatytttaaaggtatttgtcaatgata

SEQ ID NO: 918 - DNA, 47 bp, Homo Sapiens
  allele 24: 12-613-302 : polymorphic base C or G
gtatatttcaaaagaataagactsttgccaaaaagtatcaagtgttt

SEQ ID NO: 919 - DNA, 47 bp, Homo Sapiens
  allele 24: 12-614-471 : polymorphic base T or A
tttatgtttatggttctcgtcatwttccatacatatattatatgaac

SEQ ID NO: 920 - DNA, 47 bp, Homo Sapiens
  allele 24: 12-620-192 : polymorphic base G or T
tatagaatcagttagaaccctggkgccatcactgctacaggacacca

SEQ ID NO: 921 - DNA, 47 bp, Homo Sapiens
  allele 24: 12-621-49 : polymorphic base A or G
aatttagaaattatatggtaactrctactttgaattgtagcagttat

SEQ ID NO: 922 - DNA, 47 bp, Homo Sapiens
  allele 24: 12-622-325 : polymorphic base C or T
ctgccatcaagaccacatgattgygtatctccttgcaggactcaaaa

SEQ ID NO: 923 - DNA, 47 bp, Homo Sapiens
  allele 24: 12-624-82 : polymorphic base T or C
agctaccttaggacagtaaccaaytgagaaatgctgtgccataaaca

SEQ ID NO: 924 - DNA, 47 bp, Homo Sapiens
  allele 24: 12-624-83 : polymorphic base G or A
aagctaccttaggacagtaaccarctgagaaatgctgtgccataaac

SEQ ID NO: 925 - DNA, 47 bp, Homo Sapiens
  allele 24: 12-624-107 : polymorphic base T or C
gattaaccttcagatgattagccyaagctaccttaggacagtaacca

SEQ ID NO: 926 - DNA, 47 bp, Homo Sapiens
  allele 24: 12-624-146 : polymorphic base T or C
agcttgagacttttaatactaatyaccagatatgtgagtgattaacc

SEQ ID NO: 927 - DNA, 47 bp, Homo Sapiens
  allele 24: 12-624-288 : polymorphic base T or G
gtcattcttttttcctttttctckgtctctccactcgctttggagcc

SEQ ID NO: 928 - DNA, 47 bp, Homo Sapiens
  allele 24: 12-624-293 : polymorphic base T or C
tttctgtcattcttttttcctttytctctgtctctccactcgctttg

SEQ ID NO: 929 - DNA, 47 bp, Homo Sapiens
  allele 24: 12-421-135 : insertion T
aagtattggtttggagccagcatgtcccacacctcaaaattaatgtt

SEQ ID NO: 930 - DNA, 47 bp, Homo Sapiens
  allele 21: 12-442-133 : insertion C
ggaaggtgaaatgatcagggaggccagagaaagaaccacccattgca

SEQ ID NO: 931 - DNA, 47 bp, Homo Sapiens
  allele 24: 12-449-63 : insertion AT
tgatcaaaaccccaagtaaggttcatccaatatggtgtctaagcagc

SEQ ID NO: 932 - DNA, 47 bp, Homo Sapiens
  allele 24: 12-454-242 : deletion  AT
tattgagaggattaaatgaggacatgtgttatttcacaccattattg

SEQ ID NO: 933 - DNA, 47 bp, Homo Sapiens
  allele 22: 12-463-230 : deletion  CAT
caatggaaattttggaggtgacatagttaatgaagtgtcatagaaag

SEQ ID NO: 934 - DNA, 47 bp, Homo Sapiens
  allele 21: 12-462-199 : insertion  ATGTCCCACAGCTG
tgagargttaaggaacttgtctggtggtggcgtctctgggattctga

SEQ ID NO: 935 - DNA, 47 bp, Homo Sapiens
  allele 24: 10-430-287 : insertion T
attttgacctgattgttttttttactaccaatttttgaggtataatt

SEQ ID NO: 936 - DNA, 44 bp, Homo Sapiens
  allele 1: 12-718-432 : deletion  T
aaacaaaatacgatttttttttwmccacttcatagaatcctaaa

SEQ ID NO: 937 - DNA, 47 bp, Homo Sapiens
  allele 1: 12-269-301 : deletion  T
acccaaggccaccctggttttggtagatggtgcacacgcttccacta

SEQ ID NO: 938 - DNA, 47 bp, Homo Sapiens
  allele 24: 2-13-398 : insertion G
ataataggggaaatttgggggggttctagtgaggggagttggactgt

SEQ ID NO: 939 - DNA, 47 bp, Homo Sapiens
  allele 24: 2-28-132 : insertion T
tcttcaagacaactgtccttagtgtgagaaaatgtccagatttctca

SEQ ID NO: 940 - DNA, 47 bp, Homo Sapiens
  allele 24: 2-39-27 : deletion  ACAATGACAGCATCATCATCA
atcaagacaccttatctggtccaacaatgacagcatcatcatcatca

SEQ ID NO: 941 - DNA, 47 bp, Homo Sapiens
  allele 24: 2-45-155 : insertion GAC
aagaaatgtcctgtttcagtgactttccaatgcctgaagattttcca

SEQ ID NO: 942 - DNA, 47 bp, Homo Sapiens
  allele 25: 2-4-391 : deletion  G
aatattaaagctagatgtaagcaaggtttgcaacaaagtccataaga

SEQ ID NO: 943 - DNA, 47 bp, Homo Sapiens
  allele 17: 12-345-410 : deletion  TAA
tgaatataaatcctcttaaccactactgcatgcacaaatgaggcctt

SEQ ID NO: 944 - DNA, 47 bp, Homo Sapiens
  allele 19: 10-358-353 : deletion  AGCC
ctacagtaccatgcctctcagccagcccgtgtgtataatatgaagac

SEQ ID NO: 945 - DNA, 47 bp, Homo Sapiens
  allele 24: 10-360-190 : insertion T
tggaataatcacttggtcaccttgccccaagctttcccctctgaata

SEQ ID NO: 946 - DNA, 47 bp, Homo Sapiens
  allele 24: 10-365-374 : deletion  A
ctggtatgcctttctgaaaaacaatgaagttatattagtaaattcat

SEQ ID NO: 947 - DNA, 47 bp, Homo Sapiens
  allele 24: 10-367-58 : insertion GTGGAG
taagataggcacaggtacatgtgctctgtatgggttgcataaacatg

SEQ ID NO: 948 - DNA, 47 bp, Homo Sapiens
  allele 24: 12-468-424 : insertion T
atggaaaaaaaaaaaagaaactgcttagtaaagtagaaaaaatagtt

SEQ ID NO: 949 - DNA, 47 bp, Homo Sapiens
  allele 24: 12-481-293 : insertion T
atagctttgcgttgaagtttgttgttttttttctcaactagttaagt

SEQ ID NO: 950 - DNA, 47 bp, Homo Sapiens
  allele 24: 12-499-86 : deletion  CCC
tgttgttgcagcagggataaaggcccgggtcgtgacctaccaaaagg

SEQ ID NO: 951 - DNA, 47 bp, Homo Sapiens
  allele 23: 12-500-217 : insertion CAATA
tatataggaaagatatacaataatcaaagaaataatagaatttttcc

SEQ ID NO: 952 - DNA, 47 bp, Homo Sapiens
  allele 25: 12-511-101 : deletion  A
catgtcctttaagtttgtttatggaaaaaataatgacgaccacactc

SEQ ID NO: 953 - DNA, 47 bp, Homo Sapiens
  allele 24: 12-586-443 : deletion  C
aacaaagagtgaagtaaacacttcagagaatttctgtgttattcact

SEQ ID NO: 954 - DNA, 47 bp, Homo Sapiens
  allele 24: 12-593-287 : insertion TAAAT
tgtttttgaatagctatttttaagatagatatagttaggaatctaaa

SEQ ID NO: 955 - DNA, 47 bp, Homo Sapiens
  allele 24: 12-795-383 : insertion CA
tgtcttaatagacttccacattattgaggggttttttttggttttgt

SEQ ID NO: 956 - DNA, 47 bp, Homo Sapiens
  allele 24: 10-494-332 : insertion ATAAAA
atttgttatggaaaaacttaaaaataaaatgaaacttctttatattt

SEQ ID NO: 957 - DNA, 46 bp, Homo Sapiens
  allele 21: 10-494-380 : deletion  GATAA
cccgggggaaaagaataaatgataattgttggcattttatgatatg

SEQ ID NO: 958 - DNA, 47 bp, Homo Sapiens
  allele 24: 12-659-251 : deletion  TT
gaaaaaaattcaagtgactttttttcccatatgtgcagaataatatc

SEQ ID NO: 959 - DNA, 47 bp, Homo Sapiens
  allele 24: 12-912-419 : deletion  A
ctctatcaattactatcagaaaatctgttatcatcttgcctatttat

SEQ ID NO: 960 - DNA, 47 bp, Homo Sapiens
  allele 24: 12-914-28 : deletion  T
tattctctaaagtgtgttttttttcaactctctattcatatgtgctg

SEQ ID NO: 961 - DNA, 47 bp, Homo Sapiens
  allele 25: 12-624-307 : deletion  T
agacagagaaaaaggaaaaaagaatgacagaaacacagagaaaagga

SEQ ID NO: 962 - DNA, 47 bp, Homo Sapiens
  allele 24: 10-290-326 : polymorphic base A or G
gtttaagaactgaaatttgcttgrggtaggtacatccatatcatcag

SEQ ID NO: 963 - DNA, 47 bp, Homo Sapiens
  allele 24: 10-290-37 : polymorphic base C or T
cactctgcaggatcaccggtttcygactgagtctggggattttggcc

SEQ ID NO: 964 - DNA, 47 bp, Homo Sapiens
  allele 24: 10-523-232 : polymorphic base C or T
tggatggctgggtggtatttcaaycaaggtaatgttaaaatacagtc

SEQ ID NO: 965 - DNA, 47 bp, Homo Sapiens
  allele 24: 12-449-300 : polymorphic base T or C
aagccatcctctcaccttagcctyctgaacagctgggatacatgtgc

SEQ ID NO: 966 - DNA, 47 bp, Homo Sapiens
  allele 24: 10-186-212 : polymorphic base G or C
ccccgcagtggaggaggagggagsagtagaaacagtccagctcgccg

SEQ ID NO: 967 - DNA, 47 bp, Homo Sapiens
  allele 24: 10-286-289 : polymorphic base G or C
cgcttgaatcagccttttcccccsacccggtccccaactttgtttac

SEQ ID NO: 968 - DNA, 47 bp, Homo Sapiens
  allele 24: 10-286-345 : polymorphic base A or T
gaaggtcagcattcaaagtcaagwagcgccatttatcttcccgtgcg

SEQ ID NO: 969 - DNA, 47 bp, Homo Sapiens
  allele 24: 10-286-375 : polymorphic base A or G
atttatcttcccgtgcgctctacraatagttccgtgagaaagatggc

SEQ ID NO: 970 - DNA, 47 bp, Homo Sapiens
  allele 24: 10-289-201 : polymorphic base C or T
tgtacatatatggccgtcacctayacttctggggatattcagaagct

SEQ ID NO: 971 - DNA, 47 bp, Homo Sapiens; identical to SEQ ID NO: 725
  allele 24: 10-321-28 : polymorphic base A or G

SEQ ID NO: 972 - DNA, 47 bp, Homo Sapiens
  allele 24: 10-98-265 : polymorphic base A or G
cctatagccaggagaagccttgaracccaggttgtttgttcagtcta

SEQ ID NO: 973 - DNA, 47 bp, Homo Sapiens; identical to SEQ ID NO: 819
  allele 24: 12-157-115 : polymorphic base C or T

SEQ ID NO: 974 - DNA, 47 bp, Homo Sapiens
  allele 24: 12-472-48 : polymorphic base G or T
aacccaaggaactggattcttcckggtatatttcactgtaagatagg

SEQ ID NO: 975 - DNA, 47 bp, Homo Sapiens
  allele 24: 12-477-151 : polymorphic base G or A
actgcacatatttaaaatgtacartttggtaagttttgatatatgta

SEQ ID NO: 976 - DNA, 47 bp, Homo Sapiens
  allele 24: 12-479-214 : polymorphic base G or T
cctagaacagtacttgcctgatgktgagtgctcaatgaacatttgca

SEQ ID NO: 977 - DNA, 47 bp, Homo Sapiens
  allele 24: 10-290-328 : deletion of G
taagaactgaaatttgcttggggtaggtacatccatatcatcagtgg

What is claimed is:

1. A method of determining the genotype of an individual comprising the steps of:
    a) obtaining a biological sample containing a polynucleotide comprising the nucleotide sequence of SEQ ID NO:15 from said individual; and
    b) determining the identity of a nucleotide at a biallelic marker of SEQ ID NO:15, wherein said nucleotide determines said genotype of said individual.

2. The method of claim 1, further comprising amplifying a portion of said polynucleotide comprising said biallelic marker prior to said determining step.

3. The method of claim 2, wherein said amplifying is performed by PCR.

4. The method of claim 1, wherein said determining is performed by an assay selected from the group consisting of hybridization assay, sequencing assay, microsequencing assay, and enzyme-based mismatch detection assay.

* * * * *

UNITED STATES PATENT AND TRADEMARK OFFICE
CERTIFICATE OF CORRECTION

PATENT NO. : 6,528,260 B1
DATED : March 4, 2003
INVENTOR(S) : Marta Blumenfeld et al.

It is certified that error appears in the above-identified patent and that said Letters Patent is hereby corrected as shown below:

Column 7,
Lines 48, 49 and 50, "system function. Glucose 6-phosphate Dehydrogenase (G6PDH), Phosphogluconate Dehydrogenase (PGDH) and Malate Dehydrogenase: Generation of NADPH" should read (new section heading) -- Glucose 6☐phosphate Dehydrogenase (G6PDH), Phosphogluconate Dehydrogenase (PGDH) and Malate Dehydrogenase: Generation of NADPH --.

Column 33,
Line 40, "2-39-27, 245-155, 24-391, 12-345-410" should read -- 2-39-27, 2-45-155, 2-4-391, 12-345-410 --.
Line 63, "12-468-424, 12-281-293" should read -- 12-468-424, 12-481-293 --.

Column 36,
Table 3B, 3rd column, 5th item, "2590" should read -- 21590 --.

Column 40,
Line 3, "known in the aft" should read -- known in the art --.

Column 42,
Line 16, "sequence of SEQ II) No." should read -- sequence of SEQ ID No. --.

Column 51,
Line 67, "pQE-30 (QLAexpress)" should read -- pQE-30 (QIAexpress) --.

Column 52,
Line 4, "(*Mamm. Genome*, 5:397404, 1994)." should read -- (*Mamm. Genome*, 5:397☐404, 1994). --.

Column 53,
Line 28, "cells. BAC vectors:" should read -- cells.
                                                                    BAC vectors: --.
Column 56,
Line 33, "21:47834787" should read -- 21:4783☐4787 --.

Column 66,
Lines 34 and 35, "for the minor allele 30 and less than" should read -- for the minor allele and less than --.

Column 73,
Line 51, "negative populations. hi a second" should read -- negative populations. In a second --.

UNITED STATES PATENT AND TRADEMARK OFFICE
CERTIFICATE OF CORRECTION

PATENT NO. : 6,528,260 B1
DATED : March 4, 2003
INVENTOR(S) : Marta Blumenfeld et al.

It is certified that error appears in the above-identified patent and that said Letters Patent is hereby corrected as shown below:

Column 90,
Line 27, "Phenotypc permutation" should read -- Phenotypic permutation --.

Column 108,
Line 8, "not P (event C)." should read --not P (event C).--.

Column 110,
Line 7, Table 9, "A$_i$ Aj" should read -- Aj Aj --.

Column 114,
Line 45, "*Anthropol.,*1 8:104" should read -- *Anthropol.,* 18:104 --.
Line 56, "p-value of 1.2e110$^6$ and" should read -- p-value of 1.2e10$^6$ and --.

Column 127,
Table 11A (cont'd), 2$^{nd}$ column, 18$^{th}$ item, "12-502-52" should read -- 12-503-52 --.

Column 133,
All information from Page 154, Table 11A, of the application, omitted. See following table information.

Table 11A cont.

| MGST2 | 12-454-242 | 439 | 501 | N | | |
|---|---|---|---|---|---|---|
| MGST2 | 12-463-250 | 440 | 501 | N | | |
| MGST2 | 12-462-199 | 441 | 501 | N | | |
| DME | 10-430-287 | 442 | 501 | N | | |
| DME | 12-718-432 | 443 | 501 | N | | |
| CYP3A4-CYP3A7 | 12-269-301 | 444 | 501 | Y | | |
| FMO | 2-13-398 | 445 | 501 | N | | |
| FMO | 2-28-132 | 446 | 501 | N | | |
| FMO | 2-39-27 | 447 | 501 | N | | |
| FMO | 2-45-155 | 448 | 501 | N | | |
| FMO | 2-4-391 | 449 | 501 | N | | |
| GSHS | 12-345-410 | 450 | 501 | N | | |
| GLCL | 10-358-353 | 451 | 501 | N | | |
| GLCL | 10-360-190 | 452 | 501 | N | | |
| GLCL | 10-365-374 | 453 | 501 | N | | |
| GLCL | 10-367-58 | 454 | 501 | N | | |
| GLCL | 12-468-424 | 455 | 501 | N | | |
| GLCL | 12-481-293 | 456 | 501 | N | | |
| GLCL | 12-499-86 | 457 | 501 | N | | |
| GLCL | 12-500-217 | 458 | 501 | N | | |
| GLCL | 12-511-101 | 459 | 501 | N | | |
| 6PGD | 12-586-443 | 460 | 501 | N | | |

UNITED STATES PATENT AND TRADEMARK OFFICE
CERTIFICATE OF CORRECTION

PATENT NO.    : 6,528,260 B1
DATED         : March 4, 2003
INVENTOR(S)   : Marta Blumenfeld et al.

It is certified that error appears in the above-identified patent and that said Letters Patent is hereby corrected as shown below:

Column 133 (cont'd),

| 6PGD   | 12-593-287 | 461 | 501 | N |  |  |
|--------|------------|-----|-----|---|--|--|
| 6PGD   | 12-795-383 | 462 | 501 | N |  |  |
| UGT2B4 | 10-494-332 | 463 | 501 | N |  |  |
| UGT2B4 | 12-659-251 | 465 | 429 | N |  |  |
| UGT2B7 | 12-912-419 | 466 | 501 | N |  |  |
| UGT2B7 | 12-914-28  | 467 | 306 | N |  |  |
| UGT2B15| 12-624-307 | 468 | 501 | N |  |  |
| MGST2  | 10-290-326 | 469 | 501 | N |  |  |
| MGST2  | 10-290-37  | 470 | 501 | N |  |  |
| MGST2  | 10-523-232 | 471 | 501 | N |  |  |
| MGST2  | 12-449-300 | 472 | 501 | N |  |  |
| G6PDH  | 10-186-212 | 473 | 212 | N |  |  |
| MGST2  | 10-286-289 | 474 | 501 | N |  |  |
| MGST2  | 10-286-345 | 475 | 501 | N |  |  |
| MGST2  | 10-286-375 | 476 | 501 | N |  |  |
| MGST2  | 10-289-201 | 477 | 501 | N |  |  |
| GGT5   | 10-321-28  | 478 | 501 | N |  |  |
| CYP1A2 | 10-98-265  | 479 | 265 | N |  |  |
| UGT1A7 | 12-157-115 | 480 | 501 | N |  |  |
| GLCL   | 12-472-48  | 481 | 501 | N |  |  |
| GLCL   | 12-477-151 | 482 | 501 | N |  |  |
| GLCL   | 12-479-214 | 483 | 501 | N |  |  |
| MGST2  | 10-290-328 | 484 | 501 | N |  |  |

Column 135,
Table 11B (cont'd), SEQ ID No. 542, "10-453-394" should read -- 10-413-394 --.

Column 143,
SEQ ID No. 886, "12-9070482" should read -- 12-907-482 --.

Column 145,
SEQ ID No. 943, "10-345-410" should read -- 12-345-410 --.

Column 150,
SEQ ID NO. 431, "1-1061" should read -- 1-1001 --.

Column 151,
Line 26, SEQ ID No. 108, Column Alternative Allele, "  " should read -- G --.
Line 61, SEQ ID No. 184, "12484-388" should read -- 12-468-388 --.
Line 62, SEQ ID No. 185, "12468-491" should read -- 12-468-491 --.

UNITED STATES PATENT AND TRADEMARK OFFICE
CERTIFICATE OF CORRECTION

PATENT NO. : 6,528,260 B1  
DATED : March 4, 2003  
INVENTOR(S) : Marta Blumenfeld et al.

It is certified that error appears in the above-identified patent and that said Letters Patent is hereby corrected as shown below:

Column 153,
Line 66, SEQ ID No. "472" should read -- 412 --.

Column 154,
Table 15, SEQ ID No. 18,

| 18 | 1425, 920-1001 | should read

| 18 | 1-425; 920-1001 |

Line 39, SEQ ID No.

| 367 | 1433; 869-1001 | should read

| 307 | 1-433; 869-1001 |

Line 43, SEQ ID No. 334, "1402;" should read -- 1-402; --.

Column 157,
Line 55, SEQ ID No. 210 "451-500" should read -- 481-500 --.

Column 158,
Line 17, SEQ ID No. 236,

| 781-500 | 502-521 | should read

| 481-500 | 502-520* |

Line 23, SEQ ID No. 243, "781-500" should read -- 481-500 --.
Line 24, SEQ ID No. 244, "781-500" should read -- 481-500 --.

Column 159,
Line 14, SEQ ID No. "365" should read -- 305 --.
Line 33, SEQ ID No. 331, "562-521" should read -- 502-521 --.
Line 37, SEQ ID No. 336, "502-521*" should read -- 502-520* --.
Line 37, SEQ ID No. 343, "781-500" should read -- 481-500 --.
Line 44, SEQ ID No. 344, "781-500" should read -- 481-500 --.
Line 54, SEQ ID No. 356, "564-523" should read -- 504-523 --.
Line 62, SEQ ID No. 368, "564-523" should read -- 504-523 --.

Column 160
Lines 31-34, SEQ ID Nos. 403 thru 406, "502-52" should read -- 504-523 --.
Line 35, SEQ ID No. 408, "483-502*" should read -- 482-500* --.
Line 36, SEQ ID No. 409, "483-502*" should read -- 482-500* --.
Line 46, SEQ ID No. 422,

| 479-498 | 490-509 | should read

| 479-498 | 500-519 |

UNITED STATES PATENT AND TRADEMARK OFFICE
CERTIFICATE OF CORRECTION

PATENT NO. : 6,528,260 B1
DATED : March 4, 2003
INVENTOR(S) : Marta Blumenfeld et al.

It is certified that error appears in the above-identified patent and that said Letters Patent is hereby corrected as shown below:

Column 160 (cont'd),
Line 47, SEQ ID Nos. 423 thru 432 omitted. Should read:

| 423 | 481-500 | 502-520* |
|-----|---------|----------|
| 424 | 481-500 | 502-520* |
| 425 | 479-498 | 500-519  |
| 426 | 481-500 | 502-520* |
| 427 | 483-502 | 504-522* |
| 428 | 483-502 | 504-523  |
| 429 | 344-363 | 365-384  |
| 430 | 481-500 | 502-521  |
| 431 | 481-500 | 502-521  |
| 432 | 469-488 | 490-509  |

Column 164,
Line 46, SEQ ID No. "246" should read -- 240 --.

Column 165,
Line 66, SEQ ID No. "346" should read -- 340 --.

Column 167
Line 27, SEQ ID No. "446" should read -- 440 --.
Line 43, SEQ ID No. 458, "714-73" should read -- 714-734 --.

Column 168,
Line 53, SEQ ID Nos. 62 thru 65 omitted. Should read:

| 62 | 40-64   |
|----|---------|
| 63 | 27-51   |
| 64 | 119-143 |
| 65 | 154-178 |

Line 54, SEQ ID Nos. 67 and 68 omitted. Should read:

| 67 | 149-173 |
|----|---------|
| 68 | 150-174 |

SEQ ID No. 83, "7489☐513" should read -- 489-513 --.

Column 169,
Line 34, SEQ ID No. 121, "15-78" should read -- 154-178 --.
Line 35, SEQ ID No. 123, "193-277" should read -- 193-217 --.

UNITED STATES PATENT AND TRADEMARK OFFICE
CERTIFICATE OF CORRECTION

PATENT NO. : 6,528,260 B1  
DATED : March 4, 2003  
INVENTOR(S) : Marta Blumenfeld et al.

Page 6 of 10

It is certified that error appears in the above-identified patent and that said Letters Patent is hereby corrected as shown below:

Column 170,  
Line 36, SEQ ID No. 202, " " should read

| 202 | 489-513 |
|---|---|

Column 172,  
Line 60, SEQ ID No. 386, "489-318" should read -- 294-318 --.

Column 177,  
Table 23, Column 12, row 3, "277 vs 168" should read -- 277 vs 188 --.  
Table 23, Column 12, row 4, "21/16(A)" should read -- 21/18(A) --.  
Table 23, Column 13, row 4, "61/80(A)" should read -- 81/80(A) --.

Columns 177□178,  
Graph shading omitted at haplotype 6, letters G thru T; at haplotype 18, letters G thru G; at haplotype 19, letters C thru T.  
Haplotype 30, Column 12-454/363, " ", should read -- G --.

Column 179,  
Column P value (1df), haplotype 6, "3.2e-05**", should read -- 3.2e-05 ** --.

Column 180,  
Haplotype 18, Column P value (1df), "1.2e-08", should read -- 1.2e-06 --.

Haplotype 19, Column P-excess, "11.26", should read -- 11.28 --.

Columns 181-182,  
Table 24, Column 2, row 1, "12-447/56" should read -- 12-447/58 --.  
Table 24, Columns 6-7, rows 8-9,

| T | G |
|---|---|
| 7.52E-02 | 4.80E-01 | should read

| T | G |
|---|---|
| 7.52E-01 | 4.80E-01 |

Table 24, Columns 3-5, rows 13-15,

| A | T | T |
|---|---|---|
| 7.52E-01 | 6.55E-01 | 5.27E-01 |
| 0.8 (58 vs 55) | 1,6 (64 vs 63) | <2,7 (41 vs 38) | should read

| A | T | T |
|---|---|---|
| 7.52E-01 | 6.55E-01 | 5.27E-01 |
| 0,8 (56 vs 55) | 1,6 (64 vs 63) | -2,7 (41 vs 38) |

Table 24, Column 7, row 1, "12-464/363", should read -- 12-454/363 --.

UNITED STATES PATENT AND TRADEMARK OFFICE
CERTIFICATE OF CORRECTION

PATENT NO. : 6,528,260 B1
DATED : March 4, 2003
INVENTOR(S) : Marta Blumenfeld et al.

It is certified that error appears in the above-identified patent and that said Letters Patent is hereby corrected as shown below:

Columns 185 and 186
Table 26, Columns 1-4, row 3,

| size (cases / controls) | 88 vs 194 | 86 vs 195 | 56 vs 97 | should read

| size (cases / controls) | 88 vs 194 | 86 vs 195 | 66 vs 97 |

Table 26, haplotype 6, graph shading omitted at letters C, T and T.

Columns 187 and 188,
Table 26, haplotype 10, Column Chi-S, "9.60", should read -- 9.80 --.
Table 26, haplotype 13, Column P-excess, "9.67" should read -- 9.87 --.

Table 26, haplotype 19, Column Pvalue, "5.2e-07" should read -- 5.2e-07 --.

Columns 189 and 190,
Table 27, Column P value, "3.4e-02" should read -- 3.4e-01 --.
Table 27,

| PERMUTATIONS TEST RESULTS | | |
|---|---|---|
| Av. Chi-S | Max Chi-S | > Iter / no of Iter. | should read

| PERMUTATIONS TEST RESULTS | | |
|---|---|---|
| Av. Chi-S | Max Chi-S | > Iter / nb of Iter. |

Columns 191 and 192
Table 29, Column 3, row 1, "12-128/226" should read -- 12-128/225 --.
Table 29, Column 6, row 3, "88 vs 196" should read -- 88 vs 198 --.
Table 29,

| haplotype 5 | |
|---|---|
| haplotype 6 | PT3 |
| haplotype 7 | |
| haplotype 8 | | should read

| haplotype 5 | |
|---|---|
| haplotype 6 | |
| haplotype 7 | PT2 |
| haplotype 8 | |

Table 29, haplotype 6, "61 vs 196" should read -- 81 vs 196 --.
Table 29, haplotype 8, graph shading omitted at letters G thru A.
Table 29, haplotype 12, graph shading omitted at letters A thru T.
Table 29, Column Frequency Difference

| 22.8 | 8.2 |
| 35.4 | 6.5 |
| 5.2 | 6.9 | should read

| 22.8 | 6.2 |
| 35.4 | 6.6 |
| 5.2 | 8.9 |

UNITED STATES PATENT AND TRADEMARK OFFICE
CERTIFICATE OF CORRECTION

PATENT NO. : 6,528,260 B1  Page 8 of 10
DATED : March 4, 2003
INVENTOR(S) : Marta Blumenfeld et al.

It is certified that error appears in the above-identified patent and that said Letters Patent is hereby corrected as shown below:

<u>Columns 191 and 192 (cont'd),</u>
Table 29, Column pvalue: `(8.9e-02) ***` should read `(6.9e-02) *`

Table 29, Column Likelihood Ratio Test:

| 28.05 |
| 27.17 |
| 8.65 | should read

| 28.05 |
| 27.71 |
| 8.66 |

Table 29, Columns P-excess, Odds ratio and Chi-s:

| 8.01 | 1.36 | 2.36 |
| 10.27 | 1.32 | 2.14 |
| 9.35 | 2.98 | 11.45 |
| 6.49 | 2.28 | 8.33 |
| 10.87 | 1.71 | 5.27 |
| 8.51 | 1.79 | 5.19 |
| 12.60 | 1.85 | 7.08 |
| 11.84 | 1.77 | 8.15 |
| 8.65 | 1.77 | 4.97 | should read

| 8.01 | 1.38 | 2.36 |
| 10.27 | 1.32 | 2.14 |
| 9.35 | 2.98 | 11.45 |
| 6.49 | 2.28 | 6.33 |
| 10.87 | 1.71 | 5.27 |
| 8.61 | 1.79 | 5.19 |
| 12.60 | 1.85 | 7.08 |
| 11.84 | 1.77 | 6.15 |
| 8.66 | 1.77 | 4.97 |

Table 29, Column Pvalue (100 permutations), rows 12-13:

| S |
| S | should read

| S |
| S |

<u>Column 193 and 194,</u>
Table 31, Column Association Anaylsis:

| 8.8 | 2.85E-02 |
| 9.3 | 4.04E-02 |
| 8.9 | 2.53E-02 |
| 7.7 | 4.55E-02 |
| 9.6 | 3.02E-02 |
| 4.2 | 3.43E-01 |
| -9,5 | 3.20E-02 |
| -7.1 | 6.52E-02 | should read

| 8.8 | 2.85E-02 |
| 9.3 | 4.04E-02 |
| 8.9 | 2.53E-02 |
| 7.7 | 4.55E-02 |
| 9.6 | 3.02E-02 |
| 4.2 | 3.43E-01 |
| -9,5 | 3.20E-02 |
| -7.1 | 6.52E-02 |

UNITED STATES PATENT AND TRADEMARK OFFICE
CERTIFICATE OF CORRECTION

PATENT NO. : 6,528,260 B1
DATED : March 4, 2003
INVENTOR(S) : Marta Blumenfeld et al.

It is certified that error appears in the above-identified patent and that said Letters Patent is hereby corrected as shown below:

Columns 195 and 196,
Table 32, Columns 8-9, row 3: | 88 vs 199 | 85 vs 196 | should read | 88 vs 199 | 85 vs 198 |

Table 32, haplotype 1, graph shading omitted at letters T thru C.
Table 32, haplotype 35, graph shading omitted at letters A thru C.

Columns 197 and 198,
Table 32, Column frequency controls (%): 39.2 / 36.9 / 27.6 should read 39.2 / 38.9 / 27.6

Table 32, Column Chi-S: 10.14 / 9.66 / 9.57 should read 10.14 / 9.86 / 9.57

Table 32, Column Odds ratio: 2.45 / 2.08 / 2.01 should read 2.45 / 2.06 / 2.01

Table 32, Column P-value (# df): (9.4e-02) / (8.0e-02) / (1.8e-01) should read (9.4e-02) / (6.0e-02) / (1.8e-01)

Table 32, Column P-value (# df): (2.7e-01) / (2.5e-01) / (3.2e-01) should read (2.7e-01) / (2.8e-01) / (3.2e-01)

Table 32, Column P-value (100 permutations): (2.5e-01) / (6.0e-01) / (3.1e-01) should read (2.5e-01) / (6.0e-02) / (3.1e-01)

UNITED STATES PATENT AND TRADEMARK OFFICE
CERTIFICATE OF CORRECTION

PATENT NO. : 6,528,260 B1
DATED : March 4, 2003
INVENTOR(S) : Marta Blumenfeld et al.

It is certified that error appears in the above-identified patent and that said Letters Patent is hereby corrected as shown below:

Columns 199 and 200,
Table 33, Column P-value (1df):

| 38e-03 |
|--------|
| 1.7e-04 |
| 1.2e-02 | should read

| 3.8e-03 |
|---------|
| 1.7e-04 |
| 1.2e-02 |

Table 33, Column Likelihood Ratio Test and P-value (# df):

| 7.80  | (5.3e-02) |
|-------|-----------|
| 12.22 | (6.4e-03) |
| 7.65  | (5.3e-02) | should read

| 7.60  | (5.3e-02) |
|-------|-----------|
| 12.22 | (6.4e-03) |
| 7.65  | (5.3e-02) |

Signed and Sealed this

Sixteenth Day of March, 2004

JON W. DUDAS
*Acting Director of the United States Patent and Trademark Office*